United States Patent
Andersen et al.

(10) Patent No.: US 7,521,204 B2
(45) Date of Patent: Apr. 21, 2009

(54) BACILLUS HOST CELL

(75) Inventors: Jens Tonne Andersen, Naerum (DK); Steen Troels Jorgensen, Allerod (DK); Michael Dolbjerg Rasmussen, Vallensbaek (DK); Peter Bjarke Olsen, Copenhagen (DK); Ib Groth Clausen, Hillerod (DK)

(73) Assignee: Novozymes A/S, Bagsvaerd (DK)

( * ) Notice: Subject to any disclaimer, the term of this patent is extended or adjusted under 35 U.S.C. 154(b) by 418 days.

(21) Appl. No.: 10/510,386

(22) PCT Filed: Mar. 25, 2003

(86) PCT No.: PCT/DK03/00198

§ 371 (c)(1),
(2), (4) Date: Oct. 4, 2004

(87) PCT Pub. No.: WO03/093453

PCT Pub. Date: Nov. 13, 2003

(65) Prior Publication Data

US 2005/0244922 A1    Nov. 3, 2005

Related U.S. Application Data

(60) Provisional application No. 60/373,859, filed on Apr. 19, 2002.

(30) Foreign Application Priority Data

Apr. 10, 2002  (DK) ................................ 2002 00534

(51) Int. Cl.
    C12N 15/09  (2006.01)
    C12N 1/21   (2006.01)
    C12N 1/20   (2006.01)
    C12P 1/00   (2006.01)

(52) U.S. Cl. .............. 435/69.1; 435/252.1; 435/252.31; 435/41

(58) Field of Classification Search ........................ None
    See application file for complete search history.

(56) References Cited

U.S. PATENT DOCUMENTS 6,423,523 B1    7/2002   de Buyl et al.

FOREIGN PATENT DOCUMENTS

| EP | 0 369 817 | 5/1990 |
|----|-----------|--------|
| EP | 0 634 490 | 1/1995 |
| WO | WO 91/02803 | 3/1991 |
| WO | WO 92/16642 | 10/1992 |
| WO | WO 98/49328 | 11/1998 |
| WO | WO 99/45124 | 9/1999 |
| WO | WO 02/00907 | 1/2002 |

OTHER PUBLICATIONS

Craynest et al., Letters in Applied Microbiology, vol. 37, pp. 75-80 (2003).
Wu et al., Journal of Bacteriology, American Society for Microbiology, vol. 173, Part 6, pp. 4952-4958 (1991).
EP Search Report dated Oct. 20, 2006 from corresponding EP application No. 08159398.
Westers, Lidia et al., "Bacillus Subtils as Cell factory for pharmaceutical proteins: a biotechnological approach to optimize the host organism" Biochimica et Biophysica ACTA, vol. 1694, No. 1-3, pp. 299-310 (2004).
Westers, Helga et al., "Genome engineering reveal large dispensable regions in Bacillus Subtile". Molecular Biology and Evolution Dec. 2003, vol. 20, No. 12, pp. 2076-2090 (2003).
Waldeck, Jens et al., "Targeted deletion of 1-21 genes encoding extracellular enzymes in Bacillus licheniformis and the impact on the secretion capability", Journal of Biotechnology, vol. 130, No. 2, pp. 124-132 (2007).

*Primary Examiner*—Nancy Vogel
(74) *Attorney, Agent, or Firm*—Michael W. Krenicky

(57) ABSTRACT

A *Bacillus licheniformis* mutant host cell derived from a parent *B. licheniformis* host cell, which mutant host cell is mutated in one or more gene(s) encoding one or more secreted polypeptide(s) which is at least 80% identical to one or more of the polypeptides shown in SEQ ID NO's: 2 to 248, wherein the mutant host cell secretes at least 5% less of the one or more secreted polypeptide(s) than the parent host cell, when they are cultivated under comparable conditions.

21 Claims, No Drawings

BACILLUS HOST CELL

CROSS-REFERENCE TO RELATED APPLICATIONS

This application is a 35 U.S.C. 371 national application of PCT/DK2003/000198 filed Mar. 25, 2003, which claims priority or the benefit under 35 U.S.C. 119 of Danish application no. PA 2002 00534 filed Apr. 10, 2002 and U.S. provisional application No. 60/373,859 filed Apr. 19, 2002, the contents of which are fully incorporated herein by reference.

TECHNICAL FIELD

*Bacillus* sp. are attractive hosts for the production of heterologous proteins due their ability to secrete proteins directly into the culture medium. They have a high capacity for protein secretion, are genetically highly amenable, non-pathogenic and free of endotoxins, and consequently a large variety of proteins from different organisms have been efficiently produced and secreted in *Bacillus* sp. i.e. in *Bacillus licheniformis*. Improved *Bacillus* host cells that provide better production economy, or better products e.g. in terms of stability, purity etc. are constantly in demand in the industry.

BACKGROUND

Industrial production in *Bacillus* sp. of products of interest such as heterologous polypeptides, amino acids, carbohydrates etc., even when such a product is secreted into the medium, very often requires a costly purification step of the product from the culture medium. Contaminant polypeptides native to the *Bacillus* production host cell are secreted into the culture medium, and they may have to be removed e.g. in order to ensure the stability of the product, or to obtain a sufficient purity of the product. Typically, the native secreted contaminant polypeptides could be proteolytic enzymes, nutrient uptake factors, signal molecules etc.

Naturally, it is of considerable interest to the industrial producers to reduce the costs associated with product purification steps, indeed it would be of commercial value if one or more purification steps could be completely eliminated.

SUMMARY

A problem to be solved by the present invention is how to reduce the necessary product purification required when producing products of interest in a *Bacillus licheniformis* host cell. The present invention provides a solution to the problem by reducing the amount of contaminant secreted native polypeptide(s) in the culture medium, this is achieved by reducing the expression of such polypeptide(s) in a mutated host cell. Production in a mutant host cell of the invention provides a culture medium with far fewer contaminants, and this in turn makes it much easier to purify the product of interest from the culture medium to the point where certain previously required steps may be completely eliminated from the production process. Production in a mutant host cell of the invention may also have a positive effect on the total product yield and shelf-life, since product stability is often hampered by the presence of contaminant polypeptides in the culture medium.

Accordingly, in a first aspect the invention relates to a *Bacillus licheniformis* mutant host cell derived from a parent *B. licheniformis* host cell, which mutant host cell is mutated in one or more gene(s) encoding one or more secreted polypeptide(s) which is at least 80% identical to one or more of the polypeptides shown in SEQ ID NO's: 2 to 200 (both included), preferably at least 85% identical, more preferably at least 90% identical, still more preferably at least 95% identical, and most preferably at least 97% identical to one or more of the polypeptides shown in SEQ ID NO's: 2 to 200 (both included), wherein the mutant host cell secretes at least 5% less of the one or more secreted polypeptide(s) than the parent host cell, when they are cultivated under comparable conditions.

Only the even SEQ ID NO's in the range of SEQ ID NO: 2 to 200 (both included) are polypeptides, the odd sequence numbers 1 to 199 are the encoding polynucleotides. Similarly, only the even SEQ ID NO's in the range of SEQ ID NO: 206 to 248 (both included) are polypeptides, the odd sequence numbers 205 to 247 are the encoding polynucleotides. Sequence no's 201 to 204 are polynucleotide primers.

In another aspect the invention relates to a *Bacillus licheniformis* mutant host cell derived from a parent *B. licheniformis* host cell, which mutant host cell is mutated in one or more gene(s) encoding one or more secreted polypeptide(s) which is at least 80% identical to one or more of the polypeptides shown in SEQ ID NO's: 2 to 248 (both included), preferably at least 85% identical, more preferably at least 90% identical, still more preferably at least 95% identical, and most preferably at least 97% identical to one or more of the polypeptides shown in SEQ ID NO's: 2 to 248 (both included), wherein the mutant host cell secretes at least 5% less of the one or more secreted polypeptide(s) than the parent host cell, when they are cultivated under comparable conditions.

Preferably wherein the mutant host cell secretes at least 10% less, more preferably at least 20% less, still more preferably at least 30% less, even more preferably at least 40% less, yet more preferably at least 50% less, or at least 60% less, or at least 70% less, or at least 80%, or most preferably at least 90% less of the one or more secreted polypeptide(s) than the parent host cell, when they are cultivated under comparable conditions. Most preferably the mutant host cell secretes absolutely nothing of the one or more secreted polypeptide(s).

Comparable conditions of cultivation must be used in order to compare the secretion level of one or more secreted polypeptides in a mutant host cell of the invention with that in a parent host cell. They are cultivated separately under identical conditions in identical setups, of course allowing for the usual standard deviations of the operating parameters normally associated with growth experiments, such as temperature control etc. The quantification of the expression level of one or more secreted polypeptide(s) is done by standard textbook assay techniques as known in the art, often based on the biological activity of the one or more secreted polypeptide(s) i.e. if a secreted polypeptide is an amylase, then an amylase-activity based quantification assay is used. To quantify a secreted polypeptide of unknown activity, immuno based or mass-spec based assays may be used.

In a second aspect the invention relates to a process for producing at least one product of interest in a *Bacillus licheniformis* mutant host cell, comprising cultivating a *B. licheniformis* mutant host cell as defined in the previous aspect in a suitable medium, whereby the said product is produced.

Finally, an aspect of the invention relates to a use of a *Bacillus licheniformis* mutant host cell as defined in the first aspect for producing at least one product of interest compris-

DEFINITIONS

Nucleic acid construct: When used herein, the term "nucleic acid construct" means a nucleic acid molecule, either single- or double-stranded, which is isolated from a naturally occurring gene or which has been modified to contain segments of nucleic acids in a manner that would not otherwise exist in nature. The term nucleic acid construct is synonymous with the term "expression cassette" when the nucleic acid construct contains the control sequences required for expression of a coding sequence of the present invention.

Control sequence: The term "control sequences" is defined herein to include all components, which are necessary or advantageous for the expression of a polypeptide of the present invention. Each control sequence may be native or foreign to the nucleotide sequence encoding the polypeptide. Such control sequences include, but are not limited to, a leader, polyadenylation sequence, propeptide sequence, promoter, signal peptide sequence, and transcription terminator. At a minimum, the control sequences include a promoter, and transcriptional and translational stop signals. The control sequences may be provided with linkers for the purpose of introducing specific restriction sites facilitating ligation of the control sequences with the coding region of the nucleotide sequence encoding a polypeptide.

Operably linked: The term "operably linked" is defined herein as a configuration in which a control sequence is appropriately placed at a position relative to the coding sequence of the DNA sequence such that the control sequence directs the expression of a polypeptide.

Coding sequence: When used herein the term "coding sequence" is intended to cover a nucleotide sequence, which directly specifies the amino acid sequence of its protein product. The boundaries of the coding sequence are generally determined by an open reading frame, which usually begins with the ATG start codon. The coding sequence typically include DNA, cDNA, and recombinant nucleotide sequences.

Expression: In the present context, the term "expression" includes any step involved in the production of the polypeptide including, but not limited to, transcription, post-transcriptional modification, translation, post-translational modification, and secretion.

Expression vector: In the present context, the term "expression vector" covers a DNA molecule, linear or circular, that comprises a segment encoding a polypeptide of the invention, and which is operably linked to additional segments that provide for its transcription.

DETAILED DISCLOSURE

A *Bacillus licheniformis* mutant host cell derived from a parent *B. licheniformis* host cell, which mutant host cell is mutated in one or more gene(s) encoding one or more secreted polypeptide(s) which is at least 80% identical to one or more of the polypeptides shown in SEQ ID NO's: 2 to 248 (both included), wherein the mutant host cell secretes at least 5% less of the one or more secreted polypeptide(s) than the parent host cell, when they are cultivated under comparable conditions.

The term "parent host cell" in the context of the present invention means a cell which is genetically identical, or isogenic, to the progeny mutant or mutant cell of the present invention, except for the mutated one or more gene(s) encoding one or more secreted polypeptide(s) in said mutant.

The degree of identity, or %-identity of polypeptide sequences can suitably be investigated by aligning the sequences using a computer program known in the art, such as "GAP" provided in the GCG program package (Program Manual for the Wisconsin Package, Version 8, August 1994, Genetics Computer Group, 575 Science Drive, Madison, Wis., USA 53711) (Needleman, S. B. and Wunsch, C. D., (1970), Journal of Molecular Biology, 48, 443-453). Using GAP with the following settings for DNA sequence comparison: GAP creation penalty of 5.0 and GAP extension penalty of 0.3".

The object of the present invention is to provide a cleaner culture medium so as to reduce the product purification to a minimum, and this may be done according to the invention by reducing or even completely abolishing the expression of genes expressing native secreted polypeptides via mutagenisation of those genes. One of the very well-known method of ensuring that a gene is not expressed into an active polypeptide within a cell is simply to delete or partially delete the encoding gene. Many techniques have been described in the art on how to specifically delete or partially delete one or more gene(s) in the genome of a cell, and certainly from the genome of a *Bacillus licheniformis* cell (see e.g. Novozymes A/S WO 01/90393, Novozymes A/S WO 02/00907, and Example 1 herein). Accordingly, a preferred embodiment of the present invention relates to a host cell of the first aspect, which is mutated by a partial or complete deletion of the one or more gene(s) encoding the one or more secreted polypeptide(s).

A specific example of such a deletion or partial deletion is shown in an example herein, where a gene encoding the native secreted polypeptide shown in SEQ ID NO: 134 is deleted from a *Bacillus licheniformis* host cell. So, a preferred embodiment of the present invention relates to a host cell of the first aspect, which is mutated by a partial or complete deletion of a gene encoding a secreted polypeptide which is at least 80% identical to the polypeptide shown in SEQ ID NO: 134, more preferably at least 85%, still more preferably at least 90%, even more preferably at least 95%, and most preferably at least 97% identical to the polypeptide shown in SEQ ID NO: 134.

As already mentioned, it is an object of the invention to provide a cleaner culture medium, and the more secreted contaminant polypeptides that are eliminated, the fewer will have to be removed in a subsequent product purification. A preferred embodiment of the present invention relates to a host cell of the first aspect, which is mutated in two or more genes encoding two or more secreted polypeptides.

The product of interest to be produced by the mutant host cell of the first aspect may be one or more polypeptide(s) encoded by one or more heterologous gene(s). Consequently, a preferred embodiment of the present invention relates to a host cell of the first aspect, which comprises one or more heterologous gene(s) encoding one or more heterologous polypeptide(s).

In the industrial production of polypeptides it is of interest to achieve a product yield as high as possible. One way to increase the yield is to increase the copy number of a gene encoding a polypeptide of interest. This can be done by placing the gene on a high copy number plasmid. However, plasmids are unstable and are often lost from the host cells if there is no selective pressure during the cultivation of the host cells. Another way to increase the copy number of the gene of interest is to integrate it into the host cell chromosome in multiple copies. Integration of two genes has been described in WO 91/09129 and WO 94/14968 (Novozymes A/S) the content of which is hereby incorporated by reference. A preferred embodiment of the present invention relates to a host cell of the first aspect, wherein the heterologous gene(s) is present in at least two copies, preferably at least 4 copies, and most preferably at least 6 copies. In another embodiment the heterologous gene(s) is present in at least ten copies. If carried on a plasmid the gene(s) may be present in several hundred copies per cell, so in a still further embodiment of the present invention the heterologous gene(s) is present in at least 100 copies.

Integration of two genes closely spaced in anti-parallel tandem to achieve better stability has been described in WO 99/41358 (Novozymes A/S) the content of which is hereby incorporated by reference, as well as the stable chromosomal multi-copy integration of genes described in WO 02/00907 (Novozymes A/S) the content of which is incorporated herein by reference. A preferred embodiment of the present invention relates to a host cell of the first aspect, wherein the heterologous gene(s) are stably integrated into the genome of the cell.

Selection of chromosomal integrant has for convenience resulted in the use of selectable markers such as antibiotic resistance markers. However it is desirable if possible to avoid the use of antibiotic marker genes. WO 01/90393 discloses a method for the integration of a gene in the chromosome of a host cell without leaving antibiotic resistance markers behind in the strain, the content of which is hereby incorporated by reference A preferred embodiment of the present invention relates to a host cell of the first aspect wherein the heterologous gene(s) is integrated into the genome of the cell without leaving any antibiotic resistance marker genes at the site of integration.

The present invention also relates to nucleic acid constructs comprising a nucleotide sequence encoding a product of interest, which may be operably linked to one or more control sequences that direct the expression of the coding sequence in a suitable host cell under conditions compatible with the control sequences.

A nucleotide sequence encoding a polypeptide of interest may be manipulated in a variety of ways to provide for expression of the polypeptide. Manipulation of the nucleotide sequence prior to its insertion into a vector may be desirable or necessary depending on the expression vector. The techniques for modifying nucleotide sequences utilizing recombinant DNA methods are well known in the art.

Other ways of increasing the product yield would be to increase promoter activity of the specific promoter regulating the expression of a specific gene of interest. Also a more general increase in the activity of several promoters at the same time could lead to an improved product yield. The control sequence may be an appropriate promoter sequence, a nucleotide sequence which is recognized by a host cell for expression of the nucleotide sequence. The promoter sequence contains transcriptional control sequences, which mediate the expression of the polypeptide. The promoter may be any nucleotide sequence which shows transcriptional activity in the host cell of choice including mutant, truncated, and hybrid promoters, and may be obtained from genes encoding extracellular or intracellular polypeptides either homologous or heterologous to the host cell.

Examples of suitable promoters for directing the transcription of the nucleic acid constructs of the present invention, especially in a bacterial host cell, are the promoters obtained from the *E. coli* lac operon, *Streptomyces coelicolor* agarase gene (dagA), *Bacillus subtilis* levansucrase gene (sacB), *Bacillus licheniformis* alpha-amylase gene (amyL), *Bacillus stearothermophilus* maltogenic amylase gene (amyM), *Bacillus amyloliquefaciens* alpha-amylase gene (amyQ), *Bacillus licheniformis* penicillinase gene (penP), *Bacillus subtilis* xylA and xylB genes, and *prokaryotic beta-lactamase* gene (Villa-Kamaroff et al., 1978, Proceedings of the National Academy of Sciences USA 75: 3727-3731), as well as the tac promoter (DeBoer et al., 1983, Proceedings of the National Academy of Sciences USA 80: 21-25). Further promoters are described in "Useful proteins from recombinant bacteria" in Scientific American, 1980, 242: 74-94; and in Sambrook et al., 1989, supra.

Other useful promoters are described in WO 93/10249, WO 98/07846, and WO 99/43835 (Novozymes A/S) the contents of which are incorporated fully herein by reference. A preferred embodiment of the present invention relates to a host cell of the first aspect, wherein the heterologous gene(s) are transcribed from a heterologous promoter or from an artificial promoter.

The control sequence may also be a suitable transcription terminator sequence, a sequence recognized by a host cell to terminate transcription. The terminator sequence is operably linked to the 3' terminus of the nucleotide sequence encoding the polypeptide. Any terminator which is functional in the host cell of choice may be used in the present invention.

The control sequence may also be a suitable leader sequence, a nontranslated region of an mRNA which is important for translation by the host cell. The leader sequence is operably linked to the 5' terminus of the nucleotide sequence encoding the polypeptide. Any leader sequence that is functional in the host cell of choice may be used in the present invention.

The control sequence may also be a polyadenylation sequence, a sequence operably linked to the 3' terminus of the nucleotide sequence and which, when transcribed, is recognized by the host cell as a signal to add polyadenosine residues to transcribed mRNA. Any polyadenylation sequence which is functional in the host cell of choice may be used in the present invention.

The control sequence may also be a signal peptide coding region that codes for an amino acid sequence linked to the amino terminus of a polypeptide and directs the encoded polypeptide into the cell's secretory pathway. The 5' end of the coding sequence of the nucleotide sequence may inherently contain a signal peptide coding region naturally linked in translation reading frame with the segment of the coding region which encodes the secreted polypeptide. Alternatively, the 5' end of the coding sequence may contain a signal peptide coding region which is foreign to the coding sequence. The foreign signal peptide coding region may be required where the coding sequence does not naturally contain a signal peptide coding region. Alternatively, the foreign signal peptide coding region may simply replace the natural signal peptide coding region in order to enhance secretion of the polypeptide. However, any signal peptide coding region which directs the expressed polypeptide into the secretory pathway of a host cell of choice may be used in the present invention.

Effective signal peptide coding regions for bacterial host cells are the signal peptide coding regions obtained from the genes for *Bacillus* NCIB 11837 maltogenic amylase, *Bacillus stearothermophilus* alpha-amylase, *Bacillus licheniformis* subtilisin, *Bacillus licheniformis* beta-lactamase, *Bacillus stearothermophilus* neutral proteases (nprT, nprS, nprM), and *Bacillus subtilis* prsA. Further signal peptides are described by Simonen and Palva, 1993, Microbiological Reviews 57:109-137.

The control sequence may also be a propeptide coding region that codes for an amino acid sequence positioned at the amino terminus of a polypeptide. The resultant polypeptide is known as a proenzyme or propolypeptide (or a zymogen in some cases). A propolypeptide is generally inactive and can be converted to a mature active polypeptide by catalytic or autocatalytic cleavage of the propeptide from the propolypeptide. The propeptide coding region may be obtained from the genes for *Bacillus subtilis* alkaline protease (aprE), *Bacillus subtilis* neutral protease (nprT), *Saccharomyces cerevisiae* alpha-factor, *Rhizomucor miehei* aspartic proteinase, and *Myceliophthora thermophila* laccase (WO 95/33836).

Where both signal peptide and propeptide regions are present at the amino terminus of a polypeptide, the propeptide region is positioned next to the amino terminus of a polypeptide and the signal peptide region is positioned next to the amino terminus of the propeptide region.

It may also be desirable to add regulatory sequences which allow the regulation of the expression of the polypeptide relative to the growth of the host cell. Examples of regulatory systems are those which cause the expression of the gene to be turned on or off in response to a chemical or physical stimulus, including the presence of a regulatory compound. Regulatory systems in prokaryotic systems include the lac, tac, and trp operator systems. In yeast, the ADH2 system or GAL1 system may be used. In eukaryotic systems, these include the dihydrofolate reductase gene which is amplified in the presence of methotrexate, and the metallothionein genes which are amplified with heavy metals. In these cases, the nucleotide sequence encoding the polypeptide would be operably linked with the regulatory sequence.

The present invention also relates to recombinant expression vectors comprising the nucleic acid construct of the invention. The various nucleotide and control sequences described above may be joined together to produce a recombinant expression vector which may include one or more convenient restriction sites to allow for insertion or substitution of the nucleotide sequence encoding the polypeptide at such sites. Alternatively, the nucleotide sequence of the present invention may be expressed by inserting the nucleotide sequence or a nucleic acid construct comprising the sequence into an appropriate vector for expression. In creating the expression vector, the coding sequence is located in the vector so that the coding sequence is operably linked with the appropriate control sequences for expression.

The recombinant expression vector may be any vector (e.g., a plasmid or virus) which can be conveniently subjected to recombinant DNA procedures and can bring about the expression of the nucleotide sequence. The choice of the vector will typically depend on the compatibility of the vector with the host cell into which the vector is to be introduced. The vectors may be linear or closed circular plasmids.

The vector may be an autonomously replicating vector, i.e., a vector which exists as an extrachromosomal entity, the replication of which is independent of chromosomal replication, e.g., a plasmid, an extrachromosomal element, a minichromosome, or an artificial chromosome.

The vector may contain any means for assuring self-replication. Alternatively, the vector may be one which, when introduced into the host cell, is integrated into the genome and replicated together with the chromosome(s) into which it has been integrated. Furthermore, a single vector or plasmid or two or more vectors or plasmids which together contain the total DNA to be introduced into the genome of the host cell, or a transposon may be used.

The vectors of the present invention preferably contain one or more selectable markers which permit easy selection of transformed cells. A selectable marker is a gene the product of which provides for biocide or viral resistance, resistance to heavy metals, prototrophy to auxotrophs, and the like.

Examples of bacterial selectable markers are the dal genes from *Bacillus subtilis* or *Bacillus licheniformis*, or markers which confer antibiotic resistance such as ampicillin, kanamycin, chloramphenicol or tetracycline resistance.

The vectors of the present invention preferably contain an element(s) that permits stable integration of the vector into the host cell's genome or autonomous replication of the vector in the cell independent of the genome.

For integration into the host cell genome, the vector may rely on the nucleotide sequence encoding the polypeptide or any other element of the vector for stable integration of the vector into the genome by homologous or nonhomologous recombination. Alternatively, the vector may contain additional nucleotide sequences for directing integration by homologous recombination into the genome of the host cell. The additional nucleotide sequences enable the vector to be integrated into the host cell genome at a precise location(s) in the chromosome(s). To increase the likelihood of integration at a precise location, the integrational elements should preferably contain a sufficient number of nucleotides, such as 100 to 1,500 base pairs, preferably 400 to 1,500 base pairs, and most preferably 800 to 1,500 base pairs, which are highly homologous with the corresponding target sequence to enhance the probability of homologous recombination. The integrational elements may be any sequence that is homologous with the target sequence in the genome of the host cell. Furthermore, the integrational elements may be non-encoding or encoding nucleotide sequences. On the other hand, the vector may be integrated into the genome of the host cell by non-homologous recombination.

For autonomous replication, the vector may further comprise an origin of replication enabling the vector to replicate autonomously in the host cell in question. Examples of bacterial origins of replication are the origins of replication of plasmids pBR322, pUC19, pACYC177, and pACYC184 permitting replication in *E. coli*, and pUB110, pE194, pTA1060, and pAMβ1 permitting replication in *Bacillus*. The origin of replication may be one having a mutation which makes its functioning temperature-sensitive in the host cell (see, e.g., Ehrlich, 1978, Proceedings of the National Academy of Sciences USA 75: 1433).

More than one copy of a nucleotide sequence of the present invention may be inserted into the host cell to increase production of the gene product. An increase in the copy number of the nucleotide sequence can be obtained by integrating at least one additional copy of the sequence into the host cell genome or by including an amplifiable selectable marker gene with the nucleotide sequence where cells containing amplified copies of the selectable marker gene, and thereby additional copies of the nucleotide sequence, can be selected for by cultivating the cells in the presence of the appropriate selectable agent.

The procedures used to ligate the elements described above to construct the recombinant expression vectors of the present invention are well known to one skilled in the art (see, e.g., Sambrook et al., 1989, supra).

The introduction of a vector into a bacterial host cell may, for instance, be effected by protoplast transformation (see, e.g., Chang and Cohen, 1979, Molecular General Genetics 168: 111-115), using competent cells (see, e.g., Young and Spizizin, 1961, Journal of Bacteriology 81: 823-829, or Dubnau and Davidoff-Abelson, 1971, Journal of Molecular Biology 56: 209-221), electroporation (see, e.g., Shigekawa and Dower, 1988, Biotechniques 6: 742-751), or conjugation (see, e.g., Koehler and Thorne, 1987, Journal of Bacteriology 169: 5771-5278).

A preferred embodiment of the present invention relates to a host cell of the first aspect, wherein the heterologous gene(s) are comprised in an operon, preferably a polycistronic operon. The term "operon" in the context of the present invention means a polynucleotide comprising several genes that are clustered and perhaps even transcribed together into a polycistronic mRNA, e.g. genes coding for the enzymes of a metabolic pathway. The transcription of an operon may be initiated at a promoter region and controlled by a neighboring regulatory gene, which encodes a regulatory protein, which in turn binds to the operator sequence in the operon to respectively inhibit or enhance the transcription. The gene or the operon can be carried on a suitable plasmid that can be stably maintained, e.g. capable of stable autonomous replication in the host cell (the choice of plasmid will typically depend on the compatibility of the plasmid with the host cell into which the plasmid is to be introduced) or it can be carried on the chromosome of the host. The said gene may be endogenous to the host cell in which case the product of interest is a protein naturally produced by the host cell and in most cases the gene will be in it normal position on the chromosome. If the gene encoding the product of interest is an exogenous gene, the gene could either be carried on a suitable plasmid or it could be integrated on the host chromosome. In one embodiment of the invention the *eubacterium* is a recombinant *eubacterium*. Also the product of interest may in another embodiment be a recombinant protein.

The product of interest is any gene product or product of a metabolic pathway which is industrially useful and which can be produced in a bacterial cell such as a *B. licheniformis.*

In one preferred embodiment, the heterologous polypeptide(s) is an antimicrobial peptide, or a fusion peptide comprising a peptide part which in its native form has antimicrobial activity.

In another preferred embodiment, the heterologous polypeptide(s) has biosynthetic activity and produces a compound or an intermediate of interest.

Yet another embodiment relates to a host cell of the first aspect, wherein the compound or intermediate of interest comprises vitamins, amino acids, antibiotics, carbohydrates, or surfactants, and preferably the carbohydrates comprise hyaluronic acid.

In one embodiment the heterologous polypeptide(s) is an enzyme, particularly the enzyme is an enzyme of a class selected from the group of enzyme classes consisting of oxidoreductases (EC 1), transferases (EC 2), hydrolases (EC 3), lyases (EC 4), isomerases (EC 5), and ligases (EC 6). Preferably the enzyme is an enzyme with an activity selected from the group consisting of aminopeptidase, amylase, amyloglucosidase, mannanase, carbohydrase, carboxypeptidase, catalase, cellulase, chitinase, cutinase, cyclodextrin glycosyltransferase, deoxyribonuclease, esterase, galactosidase, beta-galactosidase, glucoamylase, glucose oxidase, glucosidase, haloperoxidase, hemicellulase, invertase, isomerase, laccase, ligase, lipase, lyase, mannosidase, oxidase, pectinase, peroxidase, phytase, phenoloxidase, polyphenoloxidase, protease, ribonuclease, transferase, transglutaminase, or xylanase. Preferably the enzyme is an amylase or a mannanase.

A second aspect of the invention relates to a process for producing at least one product of interest in a *Bacillus licheniformis* mutant host cell, comprising cultivating a *B. licheniformis* mutant host cell as defined in the first aspect of the invention in a suitable medium, whereby the said product is produced. One embodiment relates to a process of the second aspect, further comprising isolating or purifying the product of interest. Suitable media for the cultivation is described below as well as methods for the purification or isolation of the produced product which is an optional additional step to the process of the present invention.

In the production methods of the present invention, the cells are cultivated in a nutrient medium suitable for production of the polypeptide using methods known in the art. For example, the cell may be cultivated by shake flask cultivation, small-scale or large-scale fermentation (including continuous, batch, fed-batch, or solid state fermentations) in laboratory or industrial fermentors performed in a suitable medium and under conditions allowing the polypeptide to be expressed and/or isolated. The cultivation takes place in a suitable nutrient medium comprising carbon and nitrogen sources and inorganic salts, using procedures known in the art. Suitable media are available from commercial suppliers or may be prepared according to published compositions (e.g., in catalogues of the American Type Culture Collection). If the polypeptide is secreted into the nutrient medium, the polypeptide can be recovered directly from the medium. If the polypeptide is not secreted, it can be recovered from cell lysates.

The medium used to culture the cells may be any conventional medium suitable for growing the host cells, such as minimal or complex media containing appropriate supplements. Suitable media are available from commercial suppliers or may be prepared according to published recipes (e.g. in catalogues of the American Type Culture Collection). The media are prepared using procedures known in the art (see, e.g., references for bacteria and yeast; Bennett, J. W. and LaSure, L., editors, *More Gene Manipulations in Fungi*, Academic Press, CA, 1991).

The polypeptides may be detected using methods known in the art that are specific for the polypeptides. These detection methods may include use of specific antibodies, formation of an enzyme product, or disappearance of an enzyme substrate. For example, an enzyme assay may be used to determine the activity of the polypeptide as described herein.

The resulting polypeptide may be recovered by methods known in the art. For example, the polypeptide may be recovered from the nutrient medium by conventional procedures including, but not limited to, centrifugation, filtration, extraction, spray-drying, evaporation, or precipitation.

The polypeptides of the present invention may be purified by a variety of procedures known in the art including, but not limited to, chromatography (e.g., ion exchange, affinity, hydrophobic, chromatofocusing, and size exclusion), electrophoretic procedures (e.g., preparative isoelectric focusing), differential solubility (e.g., ammonium sulfate precipitation), SDS-PAGE, or extraction (see, e.g., *Protein Purification*, J.-C. Janson and Lars Ryden, editors, VCH Publishers, New York, 1989).

A third aspect of the present invention relates to the use of a *Bacillus licheniformis* mutant host cell as defined in the first aspect for producing at least one product of interest comprising cultivating the mutant host cell in a suitable medium whereby the said product is produced, and optionally isolating or purifying the produced product.

The present invention is further illustrated by the following examples, which, however, are not to be construed as limiting the scope of protection. The features disclosed in the foregoing description and in the following examples may, both separately and in any combination thereof, be material for realising the invention in diverse forms thereof.

EXAMPLES

Example 1

The gene encoding a small extracellular protein from *B. licheniformis* is included in the sequence shown in SEQ ID NO: 133, where the start codon of the protein encoding sequence is the ATG in position 601, and the stop codon is the TAA in position 979.

A vector designed to allow deletion of the entire open reading frame is constructed as follows:

1) An upstream DNA fragment is prepared by PCR amplification using chromosomal *B. licheniformis* DNA as template and the following primers:

```
EcoRI <L12 574-594>
                                       (SEQ ID NO: 201)
5'-gactgaattcgtgcgagttcctccacattcg-3'

HindIII BglII<L12 1074-1052>
                                       (SEQ ID NO: 202)
5'-gactaagcttagatctactctataagttagtttgtcacc-3'
```

The amplified fragment is digested with EcoRI og HindIII, inserted between the EcoRI and HindIII sites in pUC19, and the ligation mixture transformed into *E. coli* selecting ampicillin resistance (200 microg/ml).

2) The cloned DNA fragment is excised as an EcoRI-BglII fragment, and ligated to the 5.1 kb EcoRI-BglII fragment of pSJ2739 (Described in U.S. Pat. No. 6,100,063, FIG. 10). The ligation mixture is transformed into *B. subtilis* DN1885 (Diderichsen et al., 1990 (Diderichsen, B., Wedsted, U., Hedegaard, L., Jensen, B. R., Sjøholm, C. (1990). Cloning of aldB, which encodes alpha-acetolactate decarboxylase, an exoenzyme from *Bacillus brevis*. J. Bacteriol. 172, 4315-4321)), selecting erythromycin resistance (5 microg/ml) at 30° C.

3) A downstream DNA fragment is prepared by PCR amplification using chromosomal *B. licheniformis* DNA as template and the following primers:

```
KpnI BglII BamHI<L12 1500-1520>
                                       (SEQ ID NO: 203)
5'-gactggtaccagatctggatccgaaaacggttgctgtcaacgg-3'

HindIII<L12 2007-1986>
                                       (SEQ ID NO: 204)
5'-gactaagcttatcttttgtggagatgctttgg-3'
```

The amplified fragmentet is digested with KpnI og HindIII, and inserted into KpnI+HindIII digested pUC19. Transformation is into *E coli*.

4) A DNA fragment containing a spectinomycin resistance gene (spc) flanked by resolvase sites (res) originating from plasmid pAMβ1 is excised as a 1.5 kb BclI-BamHI fragment from plasmid pSJ3358 (described in U.S. Pat. No. 5,882,888), and inserted into the BamHI site of the plasmid constructed above, under 3). Transformation is into *E coli*.

5) The entire "res-spc-res-downstream DNA fragment" segment is excised from the plasmid prepared under 4), above, using enzymes BglII and HindIII, and is inserted in the plasmid prepared under 2), above, which has been digested with BglII and HindIII. Transformation is into *B. subtilis* DN1885, selecting spectinomycin resistance (120 μg/ml) and erythromycin resistance (5 μg/ml) at 30° C.

6) The plasmid constructed under 5), above, is transformed into donor strain PP289-5 (described in U.S. Pat. No. 5,882,888) for easy transfer into *B. licheniformis* by conjugation.

*B. licheniformis* strains, which do not produce the small extracellular protein, are constructed by the following procedure:

The plasmid constructed under 5), above, is transferred into the *B. licheniformis* strain by conjugation from the *B. subtilis* donor strain constructed under 6), above, as described in U.S. Pat. No. 5,882,888. Strains, in which the plasmid has integrated into the chromosome, are selected by isolation of colonies able to grow at 50° C. on plates containing erythromycin. Such colonies are then inoculated into liquid medium without antibiotics, and propagated overnight at 30° C. These cultures are used to inoculate further liquid cultures, without antibiotics, again propagated overnight at 30° C. If needed, this is repeated one or more times. Aliquots from each overnight culture are spread on plates with spectinomycin (120 μg/ml) and incubated overnight at 30° C., then replica plated onto plates with erythromycin (5 μg/ml). Colonies able to grow on spectinomycin, but sensitive to erythromycin, are picked and further investigated, e.g. by southern analysis and growth experiments. Such colonies will have the chromosomal gene encoding the small extracellular protein replaced by the res-spc-res cassette.

The spectinomycin resistance gene may subsequently be deleted from the strain by introduction of a plasmid expressing the pAMβ1 resolvase gene, as described in U.S. Pat. No. 5,882,888.

Alternatively, the res-spc-res cassette may be deleted in its entirety using a plasmid containing just the joined upstream and downstream regions flanking the gene for the extracellular protein, or such a plasmid may be used directly in the first step to delete the gene for the extracellular protein in the *B. licheniformis* strain.

SEQUENCE LISTING (248 sequences)

SEQ ID NO: 1 - DNA, 3405 bp, Bacillus licheniformis
  CDS (501)..(2906)
aatgatatcaaacctttcataccgatccctccagtttcgttttgataaaactagcaactctattaaactttcttgctctatcttatcccagcaaaatgaaaatgtttgtcacaatgtgtgtgcaaaatgattctagtttttagaagttttgttgaaaactgaaggaatcgcatgattcagcggatacaaaccatgaatgtaacttactcacagcttatcctaaggataaacacatattacccacaggatatatccacatatccacatacttattcaatatttagtataagaacgtatattccctacaatatctatacacaagtttattcacttatacacagtaaattgtgcataaatctagagaaattcactccaatacattgaatctttgaaaattatttctatatatagaaggatttttttgaaactgagagaatattttaaaagttcgaaactctaataattacaaagaaacatttatccagaagggggaaaacagattgagaaaaagtatcgtgcgctattttgttatggcttttattctattatttgcgttatccacattcctcaccggagtgcaggcaacttccgttcccgataaaaagtcgcctgagcttgagaaagctgaaatctacggtgatattgatgtgacgtctgataaacagacgacggttatcgtggaactgaaagaaaagtcgcttgccgaagcaaaagcggacggagaaaaacaaacgaaggcttctctaaaaacagctcgaagcaaagcgctgaaaacacttaaaaaagcgaaagtaaaccgcgaatacgaccgtgtattttcgggcttttctatgaaactgccggccagtgaaattccaaagctgctcgccgtcaaggaagttaaagcggtttatccaaacgcaacttacaaacctgacagcgtaaaaggaaaagacgtgacacttgcagcagacgccatttatccacagatggataaaagtgccccgttcatcggagcggatcaggcatggaaatcgggctataccggtaaaggcattaaggtagccgttattgatacgggcgtggattacacccatcccgacttaaagaataatttcggcccatataagggctatgactttgtggataatgattatgatccacaggaaacaccgacaggcgacccgcgcggcggagcgactgatcacggcactcatgttgcaggaacaatcgccgcgaacggacagattaaaggcgtggcgcctgaagcaacgcttcttgcttaccgcgtgctcggccccggcggctcaggcacaaccgagaatgtgattgcgggcattgaaaaagccgttgcagacggagcaaaagtgatgaacctctcattgggaaattcgctgaacagccctgattatgcaacaagcatcgcactggactgggcgatggctgaaggggttgtcgccgttacgtcaaacggtaacagcggaccggaaaactggacggtcggctcgccgggaacatcaagggttgcgatttccgtcggcgcatcacagcttccgtataatgagtattcggtgacgcttccttcgtattcatcagcaaaggtgatgggataccaagaggaaaaggatcttgaagcattgaacggtcaagaggtggaactcgttgaagccggcctcggacaagctgacgatttctcaggcaaagatgtgaaaggaaaagttgcggttatccagagaggcgtcataccatttgttgataaggctgaaaatgccaaaaacgccggcgctatcggagccgtgatttacaataatgcaacaggggaaatcgaggcaaacgtcatggggatggccgtaccgaccgtcaaattgtcaaaagaagagggcgaaaagcttgttcaacagatcaaagaagggaaacactccgttgtcttttctttcaaattggacaaaaagctgggggaaacaattgcctcattctcgtcccgcgggcctgtcatggatacatggatgattaaacctgacgtttcagcgccaggcgtcaacatcgtcagcaccattccgacccacgatccgaaaaacccgtacggttacggttcaaaacagggaacaagcatggcttccccgcatgtcgcgggaacggcagccatattaaagcaggccaaaccggattggacgcctgagcaaatcaaaggcgtactgatgaatacggcggaaaaactgacggatgaaaatggaaagcctctccctcacaatacgcaaggagcgggcagcatccgcatcatggaggcccttaaagcttcatccattgtaacgccgggcagccattcatacggaacattcctgaaagacaaagggaaacagacgaaaaaacaagcgttcacgattgaaaacctttcttcacacagaaaagcctatcagctcgaatactcctttaaaggaacgggcatcacggtatcaggaacggaacgagtcgtggtaccggccaatcaaacaggtaaagcagcggcaaaagtaaccgtcaattccgcgaaaacgaaagcaggcacatatgaaggcacggtttacatccgtgaagacggaagaaaagtcgccgaaatcccgctcctattgatcgtcaaagagccagactacccgcgcgtcacatccgtaacagttgaaccgggagcaaagcagggcgcttacacgatcgaagcctacctgccgggcggggctgaagagctcgcatttctcgtctatgatgaaaacctgaaccttctcggccaggccggcgtttacaaaaaccagggcaaaggctatcaatcttatcaatggaacggcaaaatcaatgacgccgcatcccttaagtccggaaaatactatatgcttgcctatgcatccgccaaagggaaatcaagctacgtattgacggaagacccttttatcgtcgaataatgacaagccttgttgagaaccactcaacaaggcttttttatgttaaaatacggataatgcgttcaggagaagctcccccttctcttcaaaacgtgaaaaaagcaatcggaggacatcgtgtatatgctttcttttatcgtattattcggcttatccttcattattgtctgctttatatttttcacgattttgtacttcgccgtcaacctgcagaagcgcgagcccaagccttttcaaaaagctgcggagcaaaccgtcgataccatcatcctcattccgatcagctggctgtttaccgctttatacatatgcattctgtttattcttttcccaatccgccattttctcgatttttttcagcaaaaacgctaaattgactgatgaaacgcttcggccagcagccggtatgaatccaatctgtcttgaaaatcgtgggtgatcgtcaccgccatgatttcgtccgttccgtaagcgccggccagttcaagcagctgtt

SEQ ID NO: 2 - protein, 802 aa, Bacillus licheniformis
LRKSIVRYFVMAFILLFALSTFLTGVQATSVPDKKSPELEKAEIYGDIDVTSDKQTTVIVELKEKSLAEAKADGEKQTKASLKTARSKALKTLKKAKVNREYDRVFSGFSMKLPASEIPKLLAVKEVKAVYPNATYKPDSVKGKDVTLAADAIYPQMDKSAPFIGADQAWKSGYTGKGIKVAVIDTGVDYTHPDLKNNFGPYKGYDFVDNDYDPQETPTGDPRGGATDHGTHVAGTIAANGQIKGVAPEATLLAYRVLGPGGSGTTENVIAGIEKAVADGAKVMNLSLGNSLNSPDYATSIALDWAMAEGVVAVTSNGNSGPENWTVGSPGTSRVAISVGASQLPYNEYSVTLPSYSSAKVMGYQEEKDLEALNGQEVELVEAGLGQADDFSGKDVKGKVAVIQRGVIPFVDKAENAKNAGAIGAVIYNNATGEIEANVMGMAVPTVKLSKEEGEKLVQQIKEGKHSVVFSFKLDKKLGETIASFSSRGPVMDTWMIKPDVSAPGVNIVSTIPTHDPKNPYGYGSKQGTSMASPHVAGTAAILKQAKPDWTPEQIKGVLMNTAEKLTDENGKPLPHNTQGAGSIRIMEALKASSIVTPGSHSYGTFLKDKGKQTKKQAFTIENLSSHRKAYQLEYSFKGTGITVSGTERVVVPANQTGKAAAKVTVNSAKTKAGTYEGTVYIREDGRKVAEIPLLLIVKEPDYPRVTSVTVEPGAKQGAYTIEAYLPGGAEELAFLVYDENLNLLGQAGVYKNQGKGYQSYQWNGKINDAASLKSGKYYMLAYASAKGKSSYVLTEDPFIVE

SEQ ID NO: 3 - DNA, 2918 bp, Bacillus licheniformis
  CDS (501)..(2573)
ctggtttacattcggcggctacggtgcggagaatgttcatcctttttttgagctgtcgggttctcccctctggtttgttgtctcacgcctgttcattgactggtggtcgctttgctttctgatttttctcggcttggcgggagtgctgatcgcaaagaaagagcagcttgctctatggctgccgcttgcgtggtcctcgggtttaatgctccttttcaaattcaatatatcctttaaagggctgctcccgggggaaggcatgctgttgtccatccatgcagcaggagcttccccgattctggccgcatcagtcagcgaaggtgcagttttcgtattatggctgatttcatatgtggcgaccgccaaaaaataggattcctcatattgctgtcttaatctccgcagagggtctgccgttttttccttcccgcttgtttaaatcctcctctttttcctcataatgataagaacattttatttatccgggaggagatttgaacatggacataatgacggacaagcgggtccgtttaaccatcaagacgatacgcgcatttttgttcatgggagcattgatgctgatcttcctttcaatcgttgtcatgacggtggtcttggcggccaaatggcaaggcgctccttcgattcaggtgccgaggtctaccgtgctgtatgacggaagcggaaagcaaatgggggaaacgcattacgggcaaaagcggtactgggtttcgctgaagaacatcaatcccgcagtcatcgatgccacgcttgccgttgaagaccggaactttttccggcaccacggctttgactatatgaggatgggcggcgccctcattgccgatttaaaggcgatgtccaaagttcagggagccagcaccatcacccagcaatatgcgagaaacctctacctcggccacgataaaacatggaaaagaaagtggaatgaagctttttatacgataaggcttgaacaaaactacacaaagaaagatattttggaaggctatttaaatacgatttattacgggcatggagcatacggaatcgaagcggcttcccggctgtattttggcaagcgggccaaagatatcaatacggcggaggctgcaatgcttgccggcattccaaagggtccttcagtttattcgccctttgtcaatgaaaaaaaagcgaaagaacgccaggaaatgatcctgacaatgatggagaaacaaaacaagctgacggaaatgcaggcggcagcactgaaaaaaatgccgctccgctttgaaaaacaggataagcaaacaaccgaaaaaaccgctccgtacttttatgacgaagctgttaaagaaatttcgcgattgctgcgtttgacgccggagcaagcggaaacaggcggctacaacgtattcaccacgctcaacccgcgtctccaaaaaattgccgaggatacgatcgaacacacgatagattcgtcatccgacattcaggcgggatttgcagcgatcaacccgtccgacggcagcgttctcgcgcttgtcggaggacgcgactacgaaaaaagcccttttaaccgcgtaacgcaggctatgcggcagcccggctccaccatgaagcctttcctttattattcggcggttcaaaacggctttacaccggccacccgaatgaggagcgcggaaacgacatttgagctcgggcaaggcagcgcttattccccgagcaactatcacggctattatgcagacggtccgatcacgcttctgcaggcactggctttgtccgataacatttacgccgtgaaaacccaccttttcctcggcatggacaaactgattgatgccgcaaagcaattcggcatcaacagcccgctgcaaaaagtgccgtcgcttgcgctcggaacatcccctgtgaagccgattgaaatggtgaacggatacgccatgtttgccaacggcgggaaaaaaatcgaaccttcctttattacgaaaattaccgatccgaacgggaaggttctttatgaaaaaccgaagcggagcaaacaaatccttgacccaaaagcggcttttatcacggcgaacatgatgagcgggatgttcgacaaatcactcaacggctatacatctgttaccggccggacgatcgcagatcagctgacgcgccgatacgccggaaaatcgggaacgaccagcaccgacagctggatgatcggcttttatcccggtcttgcttcaggcgtgtggacgggatatgacaaagagcggacaatcgatgccgtcgcagagaaaaactatgccaaacaaatttgggctgagtttatggaaaaagcgcttgaagacgcgcccgccgcagctttaatgccgcctgaaggcgtgaaagggatgtacatcgacccggctacaggttatgcggcggcgcccagctgcccgtccaaatatttcgcttattttatcaaaggtactgaacccgagcaggtttgctatggaaaggaaatctataaggagcaaaacgccgggcacgaaaagcccgccgctcccccccataagcggcaaaagtggtgggaaaaatggtttaaaaaaggagaataaactttttagggggatagacgaaccccccggacttcatggcagtccggggggtttttcctattgctggagcagtccctttttcagctcgtctgatgaacggtcccaaagcccttgatcatggtttttcagaaaatcggcaagaacgcgcttagaaccttcatccatatgctcgacgataatcttccgcttcatcgacttatccattaaattgacgtgctccggaagcgatttgtagccgcggcggatgcttctgtcgaccgtcatttcgcatgccgtcacacccgcataataagggccttcttccctgcggtcgatcgtaacccacacaagccagtaaggttt

SEQ ID NO: 4 - protein, 691 aa, Bacillus licheniformis
MDIMTDKRVRLTIKTIRAFLFMGALMLIFLSIVVMTVVLAAKWQGAPSIQVPRSTVLYDGSGKQMGETHYGQKRYWVSLKNINPAVIDATLAVEDRNFFRHHGFDYMRMGGALIADLKAMSKVQGASTITQQYARNLYLGHDKTWKRKWNEAFYTIRLEQNYTKKDILEGYLNTIYYGHGAYGIEAASRLYFGKRAKDINTAEAAMLAGIPKGPSVYSPFVNEKKAKERQEMILTMMEKQNKLTEMQAAALKKMPLRFEKQDKQTTEKTAPYFYDEAVKEISRLLRLTPEQAETGGYNVFTTLNPRLQKIAEDTIEHTIDSSSDIQAGFAAINPSDGSVLALVGGRDYEKSPFNRVTQAMRQPGSTMKPFLYYSAVQNGFTPATRMRSAETTFELGQGSAYSPSNYHGYYADGPITLLQALALSDNIYAVKTHLFLGMDKLIDAAKQFGINSPLQKVPSLALGTSPVKPIEMVNGYAMFANGGKKIEPSFITKITDPNGKVLYEKPKRSKQILDPKAAFITANMMSGMFDKSLNGYTSVTGRTIADQLTRRYAGKSGTTSTDSWMIGFYPGLASGVWTGYDKERTIDAVAEKNYAKQIWAEFMEKALEDAPAAALMPPEGVKGMYIDPATGYAAAPSCPSKYFAYFIKGTEPEQVCYGKEIYKEQNAGHEKPAAPPHKRQKWWEKWFKKGE

SEQ ID NO: 5 - DNA, 2734 bp, Bacillus licheniformis
  CDS (362)..(2236)
ttcggaatcgcacttggcgggatgattccctgcatcaccgctttaatccgggttgaatcaccggggcctatacaaggagaagtgcttggctataatgtaagtttcagatttttaggcaatgtcatcggcccggtgctcggcggcatcctttccagctttttcggtatttcttccgccttttacgcaactgcagtcctctttttcggcggagcatgccttctgatgttccaaaggtcccagcaaaaaaaatcagaggcgaaagcaagctgaaatcggataaaaaaactgccaatctatcaaattatccttctcgatatccaaaaagaatggtacgatatggctagaatttagcgaaaagagagtgacaaagttgcgttcattttttggatggatttttctgttgatgttaatacctatatttgtctttaccttaatggcctccggccgggaagctcagaatatgaagcctctcgatcaggtgctcgatgagaagatcaatataaaggatatcggccttgtacaaaacagctacatgtatgacagggacggcgctctgatttccgaaatcgtttcagatcaccaaaaccgggtattcgtcccctataaagatatccctgaacatgtgaagcagctgtttctgacttcggaggaccgtcatttctttcagcataaaggctttgattttatcgggatggcccgggccgccgcagccaatgtcaaaaaaggcggcattgatcagggggccagcacgattacacagcagctttcgagaaacttgtatttgaaccatgaacgaaccttcgaccgcaagttcactgagctcctgtattcctaccagctggaaaaaaagctttcaaaagaagaaatttttgagaaatacttaaacaccatctattttaatcacggggtctacggaattggatccgcgtcttctttctatttcagcaagcctttgaaatctctcagccttgccgaaacggcgtttatttgcgcgatccctaataaccctacattatatgatcctttgaaacattttgactacacaaaaacccgccaaaagcggctgcttgaagggctgaaaaaagcgggcgtgatcaccgaaaaagaatacagcaaagccgttaagcaaaaaattacgcttaacgtgaaagaaaagaaagacgactatcccgactatacgacctatgtcaacgaggaattcaccaaattggtgtccgctacggaagggtttgacgaacggctgaaaaaggcaaaaacaaaagaagaaaagaaaaaaatcgaaaaagagctgtcaaaccgaatcagctccctcacgacaagcggaatcaaaatttatacggcgctcgataccagcatgcaaaaccgtgtcgtccagcaagtgaagaaccgcctcccttatgaaggcgtacaaggcggagcagtggtgatcaaccaccaaacccatcaaatcgtcgccatgtccggcgggaaaaactataaaaagtacgattataacctggcattccaagcatacaggcagccggggtcatcaattaagccgctccttgactacgggccgtacattgaagaaacgggtgcgacggcaggcagcatgattgacgcaagcaaattttgcagcaaggaatactgtccgaacaacttcaacgaaagaacatacggaaccgtgtcgatcaagacagcctttaaatattcgtataatacaccagccgtacgtatgctgaaccgggtcggcgtgcaaaaaggattcagctatttaaaaccgttcggattcgataaaatcgttcaaaacgactaccgtcttcctgctgcgctgggcggatttacatggggcttctcaccgctggagatggctgatgcctatacgaccttcggcaataacggaagctacacatccagccatgcaatcacaaaggtgacggatttaaaaggaaaaacgctatacaaatggaaagacaagccgcagcaagtattcagcatgcggacaaacagccaaatgcgcgaactcttagcagcggttgttaaagaaggaaccggaaaaaaagcgaatttcagcggcggatatgtaggaggaaaaaccggaacatccaacgggtacagagacctttggtttgtcggattgacggatacatacacaatgagtgtatgggtcggaaaagaggcaaaaggcactgtcgagtacctgcatcacgcgggacctcaacttttaatctggagaggaacgctgcaatacgcatcttaaattaaaaaaaggggtggatgaaagtggcggatatgcccgatcgaatcgttctgtttgacggcgtgtgcaacttttgcgacggagccgtgcaattcattatcaaacatgatcctgaaggcttattttcattcgcttccctgcaatctgacgccggagggaatctgctcaagcaatatcacctcccttccgatcattttaacagctttattttgatcgaaaacggccgggtatatcaaaagtcaacggccgccttgcacgtggtgaaaagcctcccgggcctttggcgggccgcttccgccctcttgatcattccccggccgcttcgggacgccgtctacagtgtcattgcgaaaaaccgctacaaatggttcgggcaaaaaagcgagtgcaccgttcccggtcctgagatcagaaaacgatttttatcataaaaaaaccggagccgccggacaaacgtccgcgctccggttttttgcatggctcaaacgggcaggc

SEQ ID NO: 6 - protein, 625 aa, Bacillus licheniformis
VTKLRSFFGWIFLLMLIPIFVFTLMASGREAQNMKPLDQVLDEKINIKDIGLVQNSYMYDRDGALISEIVSDHQNRVFVPYKDIPEHVKQLFLTSEDRHFFQHKGFDFIGMARAAAANVKKGGIDQGASTITQQLSRNLYLNHERTFDRKFTELLYSYQLEKKLSKEEIFEKYLNTIYFNHGVYGIGSASSFYFSKPLKSLSLAETAFICAIPNNPTLYDPLKHFDYTKTRQKRLLEGLKKAGVITEKEYSKAVKQKITLNVKEKKDDYPDYTTYVNEEFTKLVSATEGFDERLKKAKTKEEKKKIEKELSNRISSLTTSGIKIYTALDTSMQNRVVQQVKNRLPYEGVQGGAVVINHQTHQIVAMSGGKNYKKYDYNLAFQAYRQPGSSIKPLLDYGPYIEETGATAGSMIDASKFCSKEYCPNNFNERTYGTVSIKTAFKYSYNTPAVRMLNRVGVQKGFSYLKPFGFDKIVQNDYRLPAALGGFTWGFSPLEMADAYTTFGNNGSYTSSHAITKVTDLKGKTLYKWKDKPQQVFSMRTNSQMRELLAAVVKEGTGKKANFSGGYVGGKTGTSNGYRDLWFVGLTDTYTMSVWVGKEAKGTVEYLHHAGPQLLIWRGTLQYAS

SEQ ID NO: 7 - DNA, 2914 bp, Bacillus licheniformis
  CDS (501)..(2429)
gaacttacacacttcagggggaagtccacgatgaaaaagcattctattcaatggaaggcgtttctgggcatgccggcctgttttccaccgttgacgacgcagcagtgctccttcaagtcatgctgaacggcggcggttacggaagacagcatctattcagcagttctgtcatttcacaatttacagagccgtcaaaaacaaatcccacatatggactaggatggcggctcaacggcaataccgatatggagtggatgttcggcaagcacgccagcagcaaagcatatggccataccggctggacgggaacggttactatcattgatcccgtgtatcaaatcggcattgtgttgttaaccaataaaaagcactctcctgttatcaaccctaaagaaaacccgaatcaattcgaaggtgatgaatttgcaaccggaaagtacggcagcgtcattacagctgtttacgaggcgttacatcaccaataggaggcgaccctttatatgaaaagatttcttcaatgcgcgttgattgcattgctgttatcgtctctcgctttgcagccggccgctcgcgaagcagaagcaaaacagcgtccggaacaaaacatcaaacaaatggtcagcagcatgtcgcttgaagagaaaatcgggcaaatgctgatgcctgactttagaaactggaagaaaaaaggggaatcgagcgccaaaggattaacagaaatgaatgacgaagttgctggaatcattgaaaaataccggctcgggggcgtcattctttttgctgaaaacgtcacaggcacagagcagactgtacggttaacggacggcctgcaacaagcgagccctgacattccgctctttatcacgatcgatcaggaaggcgggattgtcacgagactcgaatcaggcacaaacctggccggcaatatggcagtcggagcatcgagaagcagcaaaaacgccttcagatcaggaaaaatcatcggaaaagaattatcatcactgggcattaacgtgaatttcagtcctgtacttgatgtcaacaacaatcccgacaaccctgtcatcggcgtccgttctttcagttccaagcctgagctgacttcaaagctcggcatccagatgatgaagggccttcaggacgagcaaatgatcgccacagcaaagcactttcccggacacggcgatacagcggttgacagtcattacggattgccgcttgttccgcataatgaaaaaaggctgagaagtgttgaacttgcgccatttcaaaaggcgatcgatgcaggtattgacatgatcatgacagcgcatgtccagttccccgcctttgacgatactacctataaaagcaaaaaagacggcgaggacatcatggtgcctgctacgctttccaaaaaagtcatgacagaccttctccgcaaagatctcagctttaagggcgttgttgtaacagacgctttaaatatgaaagccatttctgataatttcggacaggaggaagccgtcgtcatggctgttaaagcaggagtcgacatcgcactcatgcccgcgcaagtcacatcgcttgagaccgaaaaaaatctggcgcgtgtattcgaagctcttctgacagccgttaaaaatggggatatccccatggaacaaatcgatcagtcggtggagcgaatccttcaattaaaaatagaccgaggcatcatagatcacaccggctccgaaccgcttcagaaaaaaatcaaatacgccttgaaaacggtcggcagcagcaaacacatgaaatacgaaaagaaaatggcaagggatagcgccactatccttaaaaacgacaaaagcaccctgccgtttaaaccgaaaaaaggggacaccgtcctcattctcgctccatatgaagagcaaacagcagcaatcgcaaagaccatcagcaaaataaggaaaaacatcaaggtagtcgaataccgctttgcagaaaaaacgtttgaggaagagattcaaaagaaaattgacgaagccgattatgtcatcacaggatcatacgtcatcaaaaacgatccggttgtgaacgacggtgtcattgatgacagcattcaagactcaagcaagtgggcaaccgcttttccgcgcgccgccatgaaatacgcgcaggccaacggaaaaaaattcgtcttaatgagcctgagaaacccttatgacacggcaaattttgaagaagccgaagccgtgattgcggtatacggctttaaaggctatgcaaacggacgcttcaggcagccgaatatcccggccggagtggaagccattttcggaaaggcaaagcctaaaggaacattgcccgtagacattccttcagtcacgcgccccggggaaaccctttacccgtatggctacggattgaatattaaaaacggcaagccgcttcacaaaggagggtcatgatgggaaaaaaagcaatctggctgcttgctggaatgtttgtcttcagtacactaaccgcagcagctgcctttccggacaaagaaaaaaaagcaaaggtctcaccgggtattgaagtgctcatgaacaaaaaaagcatattaaaaggaaaaagggtcggtctcattacaaatccaaccggtgtcaattcgacattaacaagcagcatcgatttgcttcaccaagcccccggtattgagctgaccgctctctatggtccagagcacggtgtaagaggagacgctcaagccggtgacaaggttgactcttatattgatgaaaaaaccggtctccccgtctacagcctctacggagatacgagaaagccgacaccggagatgttgaaaaacgttgacgtcctgctatttgatatccaagatgtcggaacacggttttacacttacatttacactatggcatatgcgatggaagcggcaaaagaaaat

SEQ ID NO: 8 - protein, 643 aa, Bacillus licheniformis
MKRFLQCALIALLLSSLALQPAAREAEAKQRPEQNIKQMVSSMSLEEKIGQMLMPDFRNWKKKGESSAKGLTEMNDEVAGIIEKYRLGGVILFAENVTGTEQTVRLTDGLQQASPDIPLFITIDQEGGIVTRLESGTNLAGNMAVGASRSSKNAFRSGKIIGKELSSLGINVNFSPVLDVNNNPDNPVIGVRSFSSKPELTSKLGIQMMKGLQDEQMIATAKHFPGHGDTAVDSHYGLPLVPHNEKRLRSVELAPFQKAIDAGIDMIMTAHVQFPAFDDTTYKSKKDGEDIMVPATLSKKVMTDLLRKDLSFKGVVVTDALNMKAISDNFGQEEAVVMAVKAGVDIALMPAQVTSLETEKNLARVFEALLTAVKNGDIPMEQIDQSVERILQLKIDRGIIDHTGSEPLQKKIKYALKTVGSSKHMKYEKKMARDSATILKNDKSTLPFKPKKGDTVLILAPYEEQTAAIAKTISKIRKNIKVVEYRFAEKTFEEEIQKKIDEADYVITGSYVIKNDPVVNDGVIDDSIQDSSKWATAFPRAAMKYAQANGKKFVLMSLRNPYDTANFEEAEAVIAVYGFKGYANGRFRQPNIPAGVEAIFGKAKPKGTLPVDIPSVTRPGETLYPYGYGLNIKNGKPLHKGGS

SEQ ID NO: 9 - DNA, 2820 bp, Bacillus licheniformis
  CDS (501)..(2633)
cttctttccggcggccgtcacttgggaacaggagccggaaacgtggaaagtctggtggcgtcagcggacaaggtgggctcgcggcaaccagtatgtcgtcctgaaatttttggctcagtttttcaagctgaagagaaaacggattatttttgatttgttttatttcttttttacgtattttttgtttttctttggcgtcatcatgtcaaatgcgatttttgtcatcaatttattttataatctgcatctttcattcggttttttgtctatcattttatgggttttggctttctttctatttatgacgaaggtcatgattacactgagcatcgaaaaaacagaaatgaacaggcaaaactttttcatcgtttttctgatgtactttacatactcgcaggcttggattgtgctcgtgatttattctttattcgtagaaatcaagcaccgcctgttcaagcaacatggtacaaaacagaacgatacaatcaaaagaaaagcgggtgacttttttgaaatatatcatcatatgtctggcaagcttcttgctgatcacggcgacgggacaagcggctgcagccaaagacgttacagtagacggctcgatcctgggggaaaacagccgggaacaagccaagcagcaagtgctcacaaacgatctcttgactttatacggggcaaaagacagcgccgagctgacgtatcaaataccggcgggcgcctcctctacccatcagcagcttacacttaaatacgaggcctcagaccttttaatctcaccgtcttctttaacagccgagattgatggcgaaccggtcaaaacggttaagcttgaagggaataacgggaagaaaacgctgaagctctcgctgaacaaaagccagtcgtctccagggtttcacagcttatcactgaagttctacggagtggttcatgaaggcgtctgcgtcagacaggactcctccgggaactggatcaaaatttatccggacagtcgtctgaatatcggggaaaagaacgaatctaaaggagcggcgctcgaacattatccttatccgttcgcccagtccggcagctccgtggaaaaaacggcaatcgtcattccggaccatccaagttcggctgaaatcgaagcggcagttaaaacagaagcatacctcaaaacggttgacaacagcatcagcacgaagatcttgggtgaatctgacctggcgaagatcgacaggccgacgattgtgatcggcgttcaccatcactggagcggcaaagtgaaaaagctgttgaaacaagcgaaactcgaagcaaaagaagacaagcttttgcttgcgaaacggatgctcaaagcaaaggataagcagcagcctgtattgtttgcggccgcagcatctgatgatgtgctttctgaaaaaatcagcgtcatcaccgacaaaacgtatgccgcccagctcagcggcgacacgctggcaatcggcaaacttcagcagcatagcaaacggggcggcagcaagctgacacttgaggatttcggggcgggggatttgacaatcggttcgggacagacatcttccgagcatttttattatcccgcgccagctctattagacaagaatcagcctgcaaagctttcgcttgcgatgaaaaaatcgaaaacgattcaaaagcaggccggccaaagcgacttagctgcggaacaggcggagctgaaggtcatgatcaatggccagcctcattccgtcggacttgacgatataggaaaagaagacaaaaacggcttttaccatgtttctttaaaagtcgatccgaaacttttgcaaaaaagccgttacattgatattcaatttgccgcttcaggcttgaaagagaacaacccttgctacgcggtgaacgaggacaaatggatttttatcgataaacaaagtgcattgtcttaccatgtcagcgacacgtcagcttcagcagattttcaagcgtggccgcttccctacgcgggtgatcataacaataaaacgctgatgatcctgcccgacaatgcggatcagtcgaagattgatgagctttcgcttgtagtcggctccttcggcagcgaagcccggcaggcattcacagtaaaaacatcctcggaagtcaaaccggatgacgtgaaaggaagaaacgtaatcttcatcggaagcgtcgatcaattctctctgctgaaggaaaaaacagccgaattggctgttccgacggcgaaaaacggaacatttgatgtgtcatcttttcaaatgctgaatgaaacgacaaaacaagtcgcgtttactcaaacgtcgctgtgggattcaaattactcgatggctgttttcgcgccgtttaaagggcaaggcacagcagtcacaaaagaaatgatcaactttttgaacagcaatgatttcgcagcaaccgttgtgaatgaaacggacagccatcagctatttacaaaccatcaacagctgacagcaaaatccgccgaaaccaagacggatgataaacaggaaagcaatcagcagcatgtgctgtacattgccatcctgatcgtaatcatagcggcagcggttattttgatcttgacaacggcaaggcgcagaaaaagaaaggccaatgccggcggagggattgacgaataaaacaggggcttgcttttagcccctgtttttttataagtattcaacctgtttctcatatacacccttcgcaattttagctaaaacatcgattccccttataatatcttcatccgccgcggttaggctgattcgtatacactggtgtgaatgcgccaggcgccgggattgacggtgaaagaaagat

SEQ ID NO: 10 - protein, 711 aa, Bacillus licheniformis
VTFLKYIIICLASFLLITATGQAAAAKDVTVDGSILGENSREQAKQQVLTNDLLTLYGAKDSAELTYQIPAGASSTHQQLTLKYEASDLLISPSSLTAEIDGEPVKTVKLEGNNGKKTLKLSLNKSQSSPGFHSLSLKFYGVVHEGVCVRQDSSGNWIKIYPDSRLNIGEKNESKGAALEHYPYPFAQSGSSVEKTAIVIPDHPSSAEIEAAVKTEAYLKTVDNSISTKILGESDLAKIDRPTIVIGVHHHWSGKVKKLLKQAKLEAKEDKLLLAKRMLKAKDKQQPVLFAAAASDDVLSEKISVITDKTYAAQLSGDTLAIGKLQQHSKRGGSKLTLEDFGAGDLTIGSGQTSSEHFYYPAPALLDKNQPAKLSLAMKKSKTIQKQAGQSDLAAEQAELKVMINGQPHSVGLDDIGKEDKNGFYHVSLKVDPKLLQKSRYIDIQFAASGLKENNPCYAVNEDKWIFIDKQSALSYHVSDTSASADFQAWPLPYAGDHNNKTLMILPDNADQSKIDELSLVVGSFGSEARQAFTVKTSSEVKPDDVKGRNVIFIGSVDQFSLLKEKTAELAVPTAKNGTFDVSSFQMLNETTKQVAFTQTSLWDSNYSMAVFAPFKGQGTAVTKEMINFLNSNDFAATVVNETDSHQLFTNHQQLTAKSAETKTDDKQESNQQHVLYIAILIVIIAAAVILILTTARRRKRKANAGGGIDE

SEQ ID NO: 11 - DNA, 2431 bp, Bacillus licheniformis
  CDS (519)..(1958)
agaagcttgacgtcattgttgccagcaatttattcggcgatattttgaccgatatcggggcggcgattatgggaagcataggtgtggcgccggccgccaacattaatgtaaacggcaaatatccatctatgtttgagcctgtgcacggctctgctccggacatcatctgatagcgagtcatcatcggaaaaggaatcgccaatccgatcggccaaatttggacggcaaaaatgatgctcgatcatttcggggaagaagaactcggtgcaagattgcttgacgtgattgaagacgttctaaagagcggctacttaacgcctgatatcggcggttcaagtacgacggatgatgtgacagaagaaatcatcaagcgcgtgaggaccatataagcgaaagctgccagcactccggcagctttttttgctgtggaatggaaaatcgattacatgatacgggcggttttggcgcatactacatcaagcaacaaaacatagtgcaggcagaagaggaggtataggatgaatcagaagattgtgtctgtgctcatcattgcgctcagcctgttatgcggcttggtaacaggcgccggcccgattccgttacatgatgtcgtttcaaaagcatcagcggctgaagaagctgcagccaaaagcaccgctagaaacgaattggagaaaattgagaaagcatatgacctgatttcaaatgaatatgtggagcaggtcgacagggaaaaactgttggaaggagccatacagggcatgctttcaacattgaatgacccatactcggtctatatggataaacagacggcaaagcggttttcagattcccttgattcctcttttgaaggaatcggtgcagaaatcggaatggaagacagaaaaatcattatcgtttctccttttaaacagtctccggcagagaaagccggattaaagccgaacgatgaaatcattagcatcgacggcgattccatgagcggaatggatttgaatgacgccgtattaaagatcagaggcaaaaagggatcgacggttacactgaaagttcaccgacccggaatgaaagaccagctgacatttacgattaagcgcgatgaaatcccgctggaaacggtgtttgcttccataaagaaagtacaggataaacctgtcggctatatcgcaatatcttccttttccgaacatacggcaaaagattttactgctgaactgaaaaagcttgagaaaaagggaataaaagggctcgttttggatgtaagaggaaatccgggcgggtacttgcaaagcgtggaagacattttaaaacattttgtgacaaaagatcatccgtatatacaaatcgccgaaagaaacggaaataaaaaacaatacttctcaaaattaaaagagaaaaaaccataccctgtgagcgtgatcacggacaagggcagcgcttcggcttcggaaattcttgcaggcgcattaaaagaagccgagggctacgacgtggttggcgatccttcctttggaaagggaaccgtccagcaggcggtgccgatgggagacggtagcaatattaagctgacgctgtacaaatggctgacacctaaaggaaattggatccataagcagggcattcagccgaccgttccagtcacgcagcctgcatatttctcggcggggcctttacagctgaaagaacccctcaagccggatatgaacaacaatgaaattaagcgggcgcagttcctgctgaaaggactcgggtttgtccccggccgggaagacggctattacaatgaaagcacaaaaaaagccgtcatggcgtttcaggcagcaaacaagctgaagcaaacagggatcattgaccaaaaaacggcaaatacaatgaacctgcggattgaggagaaaaagatggatgaaaagaacgatcttcagctgcaagccgcattaaaagtgctgtttaacaaaaagtgagggcacgggatgtcctcactttttttattctcagaaagtaaattctcaatctttttacctaaaatttttgctttttcataaaaaaaacattcataatgaatagaattgacccgataacataagtatatgggagactttataaggatgtaaagatgcagtaaaaatgtaacttttgcaagttgtataacataggaaaactttttaaaatagaaccaaagctttttcaagaattataatgtgtgcattttttttgcggagaatgttagcgctgtttgcgttcttcgtctctgttggtggagtcgtctgacgcttgcgcttttcttatatataaataataaatgggggtacacgattgaaaagggcaagtattgtgagagagaaaaaatactatgaattagtggagcagttaaaagttcgatcacaagacgttacgttttccgctacaaaggcagtaggattgcttatgctgt

SEQ ID NO: 12 - protein, 480 aa, Bacillus licheniformis
MNQKIVSVLIIALSLLCGLVTGAGPIPLHDVVSKASAAEEAAAKSTARNELEKIEKAYDLISNEYVEQVDREKLLEGAIQGMLSTLNDPYSVYMDKQTAKRFSDSLDSSFEGIGAEIGMEDRKIIIVSPFKQSPAEKAGLKPNDEIISIDGDSMSGMDLNDAVLKIRGKKGSTVTLKVHRPGMKDQLTFTIKRDEIPLETVFASIKKVQDKPVGYIAISSFSEHTAKDFTAELKKLEKKGIKGLVLDVRGNPGGYLQSVEDILKHFVTKDHPYIQIAERNGNKKQYFSKLKEKKPYPVSVITDKGSASASEILAGALKEAEGYDVVGDPSFGKGTVQQAVPMGDGSNIKLTLYKWLTPKGNWIHKQGIQPTVPVTQPAYFSAGPLQLKEPLKPDMNNNEIKRAQFLLKGLGFVPGREDGYYNESTKKAVMAFQAANKLKQTGIIDQKTANTMNLRIEEKKMDEKNDLQLQAALKVLFNKK

SEQ ID NO: 13 - DNA, 2542 bp, Bacillus licheniformis
  CDS (977)..(2383)
gaaatcgggcatgcgaaacggcaaaggaaattcaggagcgccttcaaaaggaactgctgcttccgtcaagcatcgggatcgctccgaataaattcctggccaaaatggcttcggatatgaaaaagccgctcggcattacgattttgagaaagcgtgaagtgccccggattctttggcccatggacatcagcgagatgtacggagtcggccggaaaaccgccgaaaagcttaagacgctcgagatcgaaaagatcggcgatttggctgccgcagatgagtatgctttaaagcgcctcctcggcatcaacggcccccgtttaaaaagaagggcaaacggcatcgacacaggagaagtgaatcccgacagaatatacgaattcaaaagcgtcggcaattcctcgaccctcccgcatgacagcacagatgagaaagagctgttcggactgattgacaagctttcaatctcagtaagcgacaggctgaagcgaaaagaggtcatggcagcaaaagttttcatcatgatccgctttgcggactggacgaacataacaagaagcaagacccttctgaatccgaccgattcaaaagacgaaattgcgaaggaatcgaaagcccttttcaggcagcattggcacggaagccctgtcaggcttttgggcgtgacgggaacagacctcgtcaatcgaaaggaagccgtcaaacagcttgatttgttttcctttcatgaggatgccaaagatgagccgatccaaaaagtgatggccgaactgaatgaaaaatatggaacagacctcatcaaaaaaggggtcaggattgtgaaaaaagaaagcaaaacgagcggaacaagctttaacaaagattttttccaagacgagagacaagatcaatagcttgaaaatgtaggtcaaagtgtggtaatttcaatttaaataaaaattaaactataatgctaaacgctttagaagggacgttagacatggcaaaacaacaaataggtgtagttggtttagcagtaatgggaaaaaacttggctttaaacattgaaagccgcgggttttcagtttctgtctacaacagatcaagcgagaaaaccgaagagtttctgaaagaagccgaaggcaaaaacgttgtcggtacatacagcattgaagagtttgttgaatctcttgaaaaaccgcgcaaaattcttttaatggtcaaagctggaacaccgacagacgcaacgattcaatcgcttctgcctcatcttgaaaaaggcgacattttgattgacggcggaaatacatattataaagatacgcagagaagaaacagggagctggccgaaagcggcattcacttcatcggcaccggcgtttccggcggtgaagaaggcgctctgaaagggccgtctatcatgccaggcggacaaaaggaagcccatgagcttgtcaagccgattcttgaagctatttctgccaaggtggacggcgaaccgtgtacgacatacatcggtcctgacggcgccggccattatgtaaaaatggttcataacggcatcgaatacggcgatatgcagctgatctcagaatcctactttattttgaaacacattgtcggtctgtcatcagatgagcttcacgaagtcttttccgagtggaataagggagagcttgacagctatctgatcgaaatcacggctgatattttcacgaaaaaagacgaggaaaccggcaagccgcttgttgacgtcatcctcgataaagcaggtcaaaaaggcacaggaaaatggacaagccaaagcgctcttgacctgggcgttccgcttccaatcattacggaatctgttttcgcccgcttcatctcttccatgaaagaggagcgcgtcaaagcgagcaagcttctggcaggacctgaagcgaaacctgccgctgagaacaaagaagagctgatcgaagcggtcagaaaagcgctcttcatgagcaaaatctgttcttacgcccaaggctttgctcaaatgaaagccgcatcagaagaatacggctgggatttgaaatacggcgatatcgcgatgattttccgcggaggatgcatcatccgcgcggcgttcctgcaaaaaatcaaagaagcgtatgaccgcgatccagagcttgacaacctgcttcttgacccgtacttcaaaaatatcgttgaaagctatcagggagccctccgcaaaacgatttctcttgcggttgaacaaggaattcctgtaccttgcttctcaagcgctctcgcttactttgacagctaccgcactgcaaccctgccggccaacctgattcaggcgcagcgcgactactttggcgcccatacgtatgagcgtacagataaagaaggcattttccacactgagtggatgaaataagatgtaaaaccgcaagctgaaaagcttgcggtttttttgattttcggaaggatgcatgtttaagcggttgtgtggaaacctactcaaaagtgagtttcaataaggaggaatcaacccatgtatccaagtttagagggaaaaacggtcgttatcaca

SEQ ID NO: 14 - protein, 469 aa, Bacillus licheniformis
MAKQQIGVVGLAVMGKNLALNIESRGFSVSVYNRSSEKTEEFLKEAEGKNVVGTYSIEEFVESLEKPRKILLMVKAGTPTDATIQSLLPHLEKGDILIDGGNTYYKDTQRRNRELAESGIHFIGTGVSGGEEGALKGPSIMPGGQKEAHELVKPILEAISAKVDGEPCTTYIGPDGAGHYVKMVHNGIEYGDMQLISESYFILKHIVGLSSDELHEVFSEWNKGELDSYLIEITADIFTKKDEETGKPLVDVILDKAGQKGTGKWTSQSALDLGVPLPIITESVFARFISSMKEERVKASKLLAGPEAKPAAENKEELIEAVRKALFMSKICSYAQGFAQMKAASEEYGWDLKYGDIAMIFRGGCIIRAAFLQKIKEAYDRDPELDNLLLDPYFKNIVESYQGALRKTISLAVEQGIPVPCFSSALAYFDSYRTATLPANLIQAQRDYFGAHTYERTDKEGIFHTEWMK

SEQ ID NO: 15 - DNA, 2030 bp, Bacillus licheniformis
  CDS (501)..(1391)
aaaacttccaaggcgaacgcttcaaagaaaacattagaaaagtgaaccagcttgcgccgatcgcggaaaaacataatgtcgacatcgcccatatcgtcttggcctggtacttggcgcggcctgaaatcgacgtgttgatcccgggcgccaaacgcgctgatcagctgatcgacaacctcaaaacggcagaagtcaatctgtctcaagaggacattgatttcatcgaccggctgtttgcccgctaaatgatcaggaaacctatcttaaaagataggtttctttatttttaaaatcctgttgacagcgcttccatttttgatatgataggaaagaagttaatacaagtgacggagaatgggagattcacaataagaccctcttgtgccaggggtttttttgtggatctctttttcttcgtcatctaagagggggcgaaagcaatcgtaatgaatagacggcacctttattctgtataacagcttgaaaggagagatcatgttatgaaaagactagtccgcagcatcttccttataacggccgcaatcgctgcttttggttttggattcagcgggcatgcggaggcggcaagccattcccagccgcagctcaatccgaacaagctactaaatgtcgcgcaccgcggcgcatcggggcatgctcccgagcacacgcttttggcttataagcttggacaaaaaatgaaaggcgattacatagaaatcgatcttcaaatgacaaaagacggccacttggtcgccatgcacgatgagacattggatcgtacgactaatggtacgggttttgtcaaagactatacgctgaaagaaatcaaagagcttgatgcaggctcctggtttaacgaagcatatcctgagcgggcaaaaccggagtacgccgggctgaaagtgcccacccttgaagaaatcatccaaacattcgggagaagcgcgcgctactatatcgaaacaaaatcaccggaagactatgatcatatggaagaaaagctcctggacatcctgaagcaatacaaattgaccggagcagacattcattcaagcaaagtcatcattcaatcttttagtcctgaaagcttaaaaatcattcataacgctaatccaaacattccgctagtgcaattattatggtacgacaaacctgctgccattactgacgccgaattaaaacaatatcaatcttacagcgtcggactcggcatgaactttgaccgcattggccgggcatacgtgcaaaagattcgacgcaccggcatgctggtccatccttatactgtgaataaaaaagaagatatgaagcggctgctcgattggggagcgaccggaatgttcaccaactttccggaccggctgcgcgatgttttgcgcgaaaagaagtaaatgaataaagaaggggaataccatgttaaaactgtttaagccagcaccgccgattgagcggctgccggaagatcaaattgattcggaatataagaaattcagactgcaagtttttctcggcatcttcatcggttatgcggcatactatttaattcgcaaaaatttctcgcttgccatgccttatttgatcgaagagggcttttcaaagtcggcgctcggctttgccttgtccgctctatccatctcttacgggctgagcaagttcgtgatggccacgatatcggaccggagcaatccgaggatgttcctgcccgccggtttgatcctttccgctgtcatcagcctcttgatggggtttgttccttttttcacctcatcgatcgccattatgtttatcatgctgttcttaaacggctggttccagggcatgggatggccgccgtcagggcgtgtccttgtccactggttcagcgtcagcgaaaggggaaataaaaccgccatatggaatgtcgcccacaatgtcggcgggggactgatggcgccgattgccgttgccggcgtcgccatcttctcaggcataacgggatctgctacaggctatgaaggtgtgtttattttgccggccttggtcgccat

SEQ ID NO: 16 - protein, 297 aa, Bacillus licheniformis
MKRLVRSIFLITAAIAAFGFGFSGHAEAASHSQPQLNPNKLLNVAHRGASGHAPEHTLLAYKLGQKMKGDYIEIDLQMTKDGHLVAMHDETLDRTTNGTGFVKDYTLKEIKELDAGSWFNEAYPERAKPEYAGLKVPTLEEIIQTFGRSARYYIETKSPEDYDHMEEKLLDILKQYKLTGADIHSSKVIIQSFSPESLKIIHNANPNIPLVQLLWYDKPAAITDAELKQYQSYSVGLGMNFDRIGRAYVQKIRRTGMLVHPYTVNKKEDMKRLLDWGATGMFTNFPDRLRDVLREKK

SEQ ID NO: 17 - DNA, 2308 bp, Bacillus licheniformis
  CDS (501)..(1814)
ggaagagcagcagcagaaaacgattgatgcgattacaaaagcgattaaatatatggcgaaacgccggattggcgcgcttctgacaattgaacgggagacgggaatgggcgattacatagaaacggggatccctttgaatgcaaaggtcagctctgagctattgatcaacatctttattccgaacactccgcttcatgacggagccgtgattatgaaaaacgatgaggttgctgcagctgcctgctaccttccgctttctgaaagcccttttatttcaaaagagcttggaacgaggcacagagcagcagtgggaatcagtgaagtgaccgacagtctgacggttgttgtatccgaagagacgggcggcatcagcgtcgccaaaaacggagaccttcaccgtgatttatcggaagaggcattgaaaaatatgcttgaagcggaatttaagaaaaattcgcgggaaacttcctcaaatcgctggtattggagggcgaagaaaaatggataagttcttaaacaatccctgggctgtcaaagttgtcgcgttattgttcgcgtttcttctttactttgcggtccacagcgctcaggcgccgactccgaagaaaccaggtgaatcgtttttcccgacatcgacaacagacgaagcgacgctcaccgatataccggtcaaatcgttttatgatgatgaaaactacgtcgtaacaggcgtgccgcagacggtgaatgtcacgattaaaggcccgaccggaaccgtcaagaaggtcagacaagtgaaggattttgagatttatgccgacatgcaaaacctgaaaacaggcaggcataaagtcgagctgaaggccagaaatgttgccgacggcctcactctgaccatcaatccatcggtgacaaccgtgacgatcgaagaaaaaacgacgaaggaattcccggtcgaggttgatttttataataaaaacaaaatgaaagacggctacacgccggagctgccgatcatcaacccgaaaaacgtcagcgtcaccggctcaaaagccgtgatcgacagaatccagaacatcaaggcgacgatcaatttagagggcgtcgaccagacggttgaaaaagaagccaagcttacagtatacgacaaggacggaaatgtcctgccggttgaagtcagcccttccgtcgttaaaatcaccgttccggtgacgagcccgagcaaaaagattccggtcaaagttgaccggaaaggcagccttccggacggcatcagcatttccagcctcgatataagtccgggagaggtgaccgtctacgggccgcaaaatgttcttgattcgttagaatttgtcgaggccgacgagattgatttaagtaaaataaaggatgatactgaattggaagccggcattaaagtgccggacggcgctaaaaaggtgtcacccgaaaaagtgaaaatcaaggtgaaagttgacaaggaagaagagaaaaaactgaaaaacgtttcaattaaaaccgcggggctgaatgacagccgggatcttgaatttctcgatccgaagtcaggcaagctggatatcacggcaaagggctcgacagccgcgatcgaaaaactccagccttccgacgtcgagctctatgtcaatgtggcggatctcgatgacggcgagcacaatgtaaagctggaagtaaacggtccgcagaacatgacatggtcgctgccgcggcaaagcattcgagtgaaaatctcatctcaaacaacccaaaacgaaaaaaacaatggtcaggatgaagaagaagagaatcattctgaaaaggattcacaaccttcatgaatcaaaaaggagcgatattaatgggcaagtattttggtacagacggtgtaagaggcgtggcaaacagtgaacttacacctgagctggcctttaaagtcggacgctttggcggatatgtcctaacaaaagataaggagcgtcccaaggttctgatcggccgtgacacgcgcatttcagggcatatgctggaaggggcccttgtagcaggccttctttcgataggagcagaagtcatgcgtctcggcgtgatttcgacgcccggagtcgcatatttgacgaaggctatggacgcggaggcgggtgtgatgatttccgcttcccacaaccctgtccaggacaacggaattaagtttttcggcggcgacggctttaagctttccgatgaacaggagcttgaaatcgagcgtctgatggatcagccggaagatcacctgccaaggcctgtaggcgctgatctgggcatggtgaacgactactttgaaggcggacag

SEQ ID NO: 18 - protein, 438 aa, Bacillus licheniformis
MDKFLNNPWAVKVVALLFAFLLYFAVHSAQAPTPKKPGESFFPTSTTDEATLTDIPVKSFYDDENYVVTGVPQTVNVTIKGPTGTVKKVRQVKDFEIYADMQNLKTGRHKVELKARNVADGLTLTINPSVTTVTIEEKTTKEFPVEVDFYNKNKMKDGYTPELPIINPKNVSVTGSKAVIDRIQNIKATINLEGVDQTVEKEAKLTVYDKDGNVLPVEVSPSVVKITVPVTSPSKKIPVKVDRKGSLPDGISISSLDISPGEVTVYGPQNVLDSLEFVEADEIDLSKIKDDTELEAGIKVPDGAKKVSPEKVKIKVKVDKEEEKKLKNVSIKTAGLNDSRDLEFLDPKSGKLDITAKGSTAAIEKLQPSDVELYVNVADLDDGEHNVKLEVNGPQNMTWSLPRQSIRVKISSQTTQNEKNNGQDEEEENHSEKDSQPS

SEQ ID NO: 19 - DNA, 2632 bp, Bacillus licheniformis
  CDS (852)..(2606)
atatgttttaatgaagaaaatctccaggccgctcttcgttttcagatataaatgtcagcgcgtcgccagcctggcggttcgatttattgtgagttgaaacatcgccgagcgtaatgatgccggcaagcgtttttccccgtgtaaccgggacccttctgatctgataatctcccatgagatcgaccgcttttcaatgaatgtttacacttaccgtaatgatagaagggccctttggatatgaacgattcatcgaagcgatcccgtcttataaagaagtgtttggcacagacgaaaaggtgtggacaaaagcatcgccgctctcatacataaacaactcaaaattgccgccggcctatcttgtgacccgctgggaagaccctgccgtttacaagttcgcggaaaccgcaaacaaagcgaaggcaacggaatttgtgtatcaagtcaacagcttatctcacagtgatttaaacaagatgttcggctctccagatgcaccggcagaagcgcagaatctgacaaaagcggttatggcgtttttagagaaggaaaataaatagatcaaacggccgactcggcttcctacatgtacttgctgaaaggatataaacagctgttaaactagcagagaaaggccgaaaatgttaaattcggcctcttctcacacttggcacccccttactcataagacatcgatctgaaaattcccaaaatataaacaaaacattaataaaatcaagccatttgattaacaaatttacgatacgatcatatagaacttgatgattgggaaaagcattttgagagaagattaagagcaagggagatatgatgtgagaatgaaacgattaaggatgaggaagcatttactgatagctgtctgtactttggcacttcttctaagttccccgattgtaagcgatgcgagcccggcaactaaaccaacaactgcagattcgccgcaatcttccggatttttcgtagaccattacaaaaataatatctctgccaatacgacggcggaatccaatcctgtcatcggcctgctttccgaatttaataaactttggactcccggaaagacatggaataccggtactaaactgaacagcagggtgctggatgccaacattcaaaaagtcgtggatattgctgaacgccgcacgatgcttgaggaaaatgctgcctattttgatgatcggcggagccagagctacagtataattgacggcctcggcaagcttgccggcgtctatcgaatgaacgcgggagcgacgacaacgatcaccagcattccggcagatgcctcgattagaaaatacaatgatgaaggaaccaattcgggcagcaccagctctgaacttggaaatgtcgtaagtttggtcaatactttacgcggcaactattcttcatcgaatccggctaaaagctatttcaactatccccgcccgtttcgctggaaagacaattcgatcattgttccaacgcttatccccgtcatcaatcctgatccgaacaaagacggaggttttccaagcggacacacgaacgccgcatatctcagcgcttttgctatggcctatgcgataccggagcgttatcaggagctgctgactcgcgcttcagaactcggtcataaccggattgttgccggtatgcattccccgctggacgtcatggggggacgagtaatggcaacagctttgtctgcagcaatcctgtctgaccccgcaaatgaaagattgaagaaaacggcttttgatgaagcccgccgtaaattattaacgcaaaccggtacagctgaagacagatacagcgattatgagaagaataaaaaacaatatacggaacgattgacatatggatttcgacaaatgaacaaaaccgccaaaccaatggcagttccaaagggagccgaagtcctgctggaaacacgttttccttaccttgacaaaaagcagcgccgttcggttttagccactaccggtcttccggccggctaccctgttcttgatgatcgagaaggatggggaaggcttaatctcttttccgcggcagatgggtatggggcttttaccaaaaatgttaccgtgaccatggattccgcaaaaggcggcttccatacagccgatcgctggcgcaacgacatctccggcaccggaaagctgaccaaaaaagggacaggcgctttgaagctggaaggggataatacatattccggcggtacacggattgatcaaggaacacttgagggcggttcggagacagctttcgggagaggtgatgttgcactaaacggaggcatccttaaggaagatgcgccgggaaaactgatcatcgaaggagactacaaacaatctgctaaaggaatacttgaacttcagctcagcggcaaaaaagatcagttgaaaattaagggaaaagcaagattgaaagggacattgcgtctcaattttacggacaattacgtaccggctgacggatcggcgatcataaccttccgcaagcgtcatggatcattttcttccgtcgagaccagtggattgccaagcaagtataaagtgaagatcatctataaatccaacagtattcagttgaaagttgagcaaaaggggagaagctgatctgcaagagg

SEQ ID NO: 20 - protein, 585 aa, Bacillus licheniformis
MRKHLLIAVCTLALLLSSPIVSDASPATKPTTADSPQSSGFFVDHYKNNISANTTAESNPVIGLLSEFNKLWTPGKTWNTGTKLNSRVLDANIQKVVDIAERRTMLEENAAYFDDRRSQSYSIIDGLGKLAGVYRMNAGATTTITSIPADASIRKYNDEGTNSGSTSSELGNVVSLVNTLRGNYSSSNPAKSYFNYPRPFRWKDNSIIVPTLIPVINPDPNKDGGFPSGHTNAAYLSAFAMAYAIPERYQELLTRASELGHNRIVAGMHSPLDVMGGRVMATALSAAILSDPANERLKKTAFDEARRKLLTQTGTAEDRYSDYEKNKKQYTERLTYGFRQMNKTAKPMAVPKGAEVLLETRFPYLDKKQRRSVLATTGLPAGYPVLDDREGWGRLNLFSAADGYGAFTKNVTVTMDSAKGGFHTADRWRNDISGTGKLTKKGTGALKLEGDNTYSGGTRIDQGTLEGGSETAFGRGDVALNGGILKEDAPGKLIIEGDYKQSAKGILELQLSGKKDQLKIKGKARLKGTLRLNFTDNYVPADGSAIITFRKRHGSFSSVETSGLPSKYKVKIIYKSNSIQLKVEQ

SEQ ID NO: 21 - DNA, 2772 bp, Bacillus licheniformis
  CDS (501)..(2276)
ttcttgaatctgcggatatattggcgtaagtattgtacgataaatccaaatagcgacccaccctaaacacaatgcaataattatctttttgtaataattggggtcatgtttaattgttttttccacggtatgagaacgctcccttcttttaatctattttttatttaattaaattgtaggttgtaagccagtcaataacattgttcactttcaacaaaaacaaaagtaacattatacattttagacaaaaggcgtcgcttaaaaatgattcatcgatagaagctggccttatgactcttttttaaaactaacttggagtacccaatttaacttcccgaataaacaggaagcttcacaaatgttgatataacagtgtttttaacgttttaaaaactaaaggtgcatgacaagcgaccttaagataagctttctttctctttgaaaattcaaaaatcctccgatatatatagcgaacgccgctaaaaaaggaggagagccggatgaaaaagttatggaaaatcgcggtttcggctgcaatgttcgtcggttttttcgcaaattcaccccgcattcaagcggaaagcaataagcaggaaaacgaggtcattgttgtatataaaaataccagcggaaaagaaaccgtcatcgaacaggcagacacggtagaacacgtttaccggcacattcccgcagccgctgtcactgcggacgacaaaacagtgcgcgaacttgaacacgatcccgacgtcctgtatgtcgaagacaacctcccggtagctgctgccgacagcaccgctctaaaagctttctccagcagcacagcgcaaaacgcctccgcgttttcacagtggaacatcaagctgattcaagccgcactggcttggaataaaggtttgaccggaaaacaggtgaagatcgcggttattgacagcgggatttccccccatgaggagctgtcgatcgccggcggtgcatcgatggtcggctataccgcttcataccgtgacgataatggccacggaacccatgttgccggaatcatcggagcgaagcataacggacgggggatcgacggcatcgcgcccggcgcgcagctgtatgccgtaaaagcgctggaccggaatggtgcgggggatctgaaaggtatcttacaaggcatcgattggtcgatccaacacggaatcgatatcatcaatatgagcctcgtcgtttcaggcgacagtcaagttctccacgatgcggtagataaagcatacaaacggggaatcattttagtcggagcgagcggaaatgccggaaacggaaaatccgtttattacccggccgcctacagcagcgtcattgccgtctcggcaaccaatgaaaaaaatcagatcgcctcatttaccaacacccggagcgccgtatcgtattccgctccgagcacatctattatcaatacatcgggcaatcgcggatatgcaatcggaagctgcactgcacaagggacacccgacgtcacctgcgtgatcgcacttatgaaacagctgcacccaaccgcttcaaatgctgagctgcgcaagaaaatgcagttttatacaagcgatttgggcgctcccggtcgtgatcatttgttcggctaccgattaatccgcttcaaagaggtcacacagccattggaaaaagcgcaaaaagccgtcggacaagcggaaaagacaaagaaaaaagcggacattcaaaccgcacaaaaagcgatcgaaccgctccctgcagacgcagataaacccgctttgaaaaagagactcaatactgttaaagagcagcttaaaaaaacagccgaaagcaaagtgaaactcgctgagaagcaaaaaaagaaaaccaatgccgactccgcccaaaaagcggtcaacgaactcgacagcggcactttcaaaacgaatttgcaaaaacggatcaacgcggtccgttcaagcctcttgaagaccgcaaagcaggccgttgccaaagctgaaaaagcggcaacagactcaaacctcggcaaagcgcaaaaagcgatcaatgagcttcccgccggaaaagacaaatcaaatctgcaaaaaaggctgaacaccgcgaaaaagcaagcagctgcagcctataataaaaaagtttctgcagcaaaggccaaagtcaaaacggccgaacaaaagagaacgaaaaaaacaaaatcagcagcgcaatcagcagtaggcaagctgaaagcatccgccgaaaaaacgaagctgcaaaaacggatcaatgccattaagctgaagtagtacggaaaaaagcccggaatcatccgggccttttaattttcatatttagcaaatgcgtcattattgatgctgttgtactaattgacatttcgggctcgtcatttgcgtaatcgtattccttggtcggccgcttactctcccccgtactctccaatcacttcttatcaattctttccgtcacaatcccgacgatgtcccgttctgaaacaaagccgaaatggcggctgtcaaagctgtggatccggttgtccccgaggacgaagtactcgttttcaggcaccttctcctctccggtcacttcctgcagtgtaaaatcccctgtcaagtcccctccggcggtgacggcctttaagtcgtccagataaggctctttgatcttttcttcgttgatatacagctgatcatcttcatacctgagggtttcgcccggaagcccgatcacccttttaatgaatatatctttgtcaggtcctttaaacagcacgatgtcaaatcg

SEQ ID NO: 22 - protein, 591 aa, Bacillus licheniformis
MKKLWKIAVSAAMFVGFFANSPRIQAESNKQENEVIVVYKNTSGKETVIEQADTVEHVYRHIPAAAVTADDKTVRELEHDPDVLYVEDNLPVAAADSTALKAFSSSTAQNASAFSQWNIKLIQAALAWNKGLTGKQVKIAVIDSGISPHEELSIAGGASMVGYTASYRDDNGHGTHVAGIIGAKHNGRGIDGIAPGAQLYAVKALDRNGAGDLKGILQGIDWSIQHGIDIINMSLVVSGDSQVLHDAVDKAYKRGIILVGASGNAGNGKSVYYPAAYSSVIAVSATNEKNQIASFTNTRSAVSYSAPSTSIINTSGNRGYAIGSCTAQGTPDVTCVIALMKQLHPTASNAELRKKMQFYTSDLGAPGRDHLFGYRLIRFKEVTQPLEKAQKAVGQAEKTKKKADIQTAQKAIEPLPADADKPALKKRLNTVKEQLKKTAESKVKLAEKQKKKTNADSAQKAVNELDSGTFKTNLQKRINAVRSSLLKTAKQAVAKAEKAATDSNLGKAQKAINELPAGKDKSNLQKRLNTAKKQAAAAYNKKVSAAKAKVKTAEQKRTKKTKSAAQSAVGKLKASAEKTKLQKRINAIKLK

SEQ ID NO: 23 - DNA, 2347 bp, Bacillus licheniformis
  CDS (513)..(1856)
actgacacccgttcatatggaattaatcaattcaatcggcgatgacccgctgctgccgattttggccatggggggcgcaggacaagtaggcgccgcttttgcgatctatttcaaaacgaaaaaagcaaagctaaaaagagccattgccggcggactgccgtcaggcctgctcggcatcggcgaaccgctcatattcggtgtaacccttccgctcggacgtccgtttttaaccgcgtgcctcggggccggagtaggcggagcatttcaagcgtatttcaaaattgcgaccgtatcgataggcgtatcagggctccctttgtcgtttttggttcatacccaccaagttcttttgtatattctcggtttgtttatttcctatgctgccggctttgtcttaacatactcctttggtttcaaggacgatatggcagttgaatttgattaaacgtttgtttaaaatttcccactatgcaatttttaacagaaaggagtgaagcaagctgaaaaagtttatgatcagtgcggccgcgtccctattgctgctgacatgcttttttccgcttccgtccacagcacagactgccatcgggaacgagacaaaacagcggctgacatatcctgttttaacgaaagcgaaaacgcctgaagaagccggtttttcttcgaaaaagcttaaagctgtggaccgtctgatcgaacaggatgtcaaagcgggctttcccggcgctgcccttattttgattaaagacggaaaaatcatcaaaaaagaagtctacggctacaagcagaaatacaacggcctcatagcgctcaaacatccaaaaaaaatgaaagcaaacacgatgttcgacctagcctccaatacaaaaatgtatgccgtcaattttgccttgcagcatttagtgagcaccggaaagcttgacttgaacaaaaacatttctcaatatctccctgatttcaaagatcacccggaagacgatgtaaagggaaaaaaccggctccgcgtgattgatttgcttcatcataacgcaggcttccctgcaagctggaattattacgacccgaaatcagccggacacctctactctcaatcacggagcaaaacgcttgaatatcttgtgaaaacccccttggcatatgaacccggcacaaagcaaatttacagtgacatcgactatatgctcctcgggctgatcattgaaaaaatcacaaacgagcgtttagatacctttgttgaaaaccggttttaccggcctctcggattgcggcatactttgtttaatccgctccaaaagggctttaaacggtcgcattttgcagctacggaacgattgggaaacaccagagacggcaccatttcgttcccaaacatcagaacttacacacttcagggggaagtccacgatgaaaaagcattctattcaatggaaggcgtttctgggcatgccggcctgttttccaccgttgacgacgcagcagtgctccttcaagtcatgctgaacggcggcggttacggaagacagcatctattcagcagttctgtcatttcacaatttacagagccgtcaaaaacaaatcccacatatggactaggatggcggctcaacggcaataccgatatggagtggatgttcggcaagcacgccagcagcaaagcatatggccataccggctggacgggaacggttactatcattgatcccgtgtatcaaatcggcattgtgttgttaaccaataaaaagcactctcctgttatcaaccctaaagaaaacccgaatcaattcgaaggtgatgaatttgcaaccggaaagtacggcagcgtcattacagctgtttacgaggcgttacatcaccaataggaggcgaccctttatatgaaaagatttcttcaatgcgcgttgattgcattgctgttatcgtctctcgctttgcagccggccgctcgcgaagcagaagcaaaacagcgtccggaacaaaacatcaaacaaatggtcagcagcatgtcgcttgaagagaaaatcgggcaaatgctgatgcctgactttagaaactggaagaaaaaaggggaatcgagcgccaaaggattaacagaaatgaatgacgaagttgctggaatcattgaaaaataccggctcgggggcgtcattctttttgctgaaaacgtcacaggcacagagcagactgtacggttaacggacggcctgcaacaagcgagccctgacattccgctctttatcacgatcgatcaggaaggcgggattgtcacgagactcgaatcaggcacaaacctggccggcaatatggcagtcggagcatcgagaagcagcaaaaacgccttcagatcagg

SEQ ID NO: 24 - protein, 448 aa, Bacillus licheniformis
MISAAASLLLLTCFFPLPSTAQTAIGNETKQRLTYPVLTKAKTPEEAGFSSKKLKAVDRLIEQDVKAGFPGAALILIKDGKIIKKEVYGYKQKYNGLIALKHPKKMKANTMFDLASNTKMYAVNFALQHLVSTGKLDLNKNISQYLPDFKDHPEDDVKGKNRLRVIDLLHHNAGFPASWNYYDPKSAGHLYSQSRSKTLEYLVKTPLAYEPGTKQIYSDIDYMLLGLIIEKITNERLDTFVENRFYRPLGLRHTLFNPLQKGFKRSHFAATERLGNTRDGTISFPNIRTYTLQGEVHDEKAFYSMEGVSGHAGLFSTVDDAAVLLQVMLNGGGYGRQHLFSSSVISQFTEPSKTNPTYGLGWRLNGNTDMEWMFGKHASSKAYGHTGWTGTVTIIDPVYQIGIVLLTNKKHSPVINPKENPNQFEGDEFATGKYGSVITAVYEALHHQ

SEQ ID NO: 25 - DNA, 3060 bp, Bacillus licheniformis
  CDS (389)..(3058)
tttgcggaggagcatgcagaacatcggaggggtgctcgggttgtcgtaggtttcgtttgtcaggtgtacccgcgcataactcggatgggcggagagcagcaatttgcggttcttcccgtttgccctgatatgaaacactagctcgtgcttaaacggctggggatttttgcgatccgtccgcctcgaatcgcctcatttaattcctcgatcattccgtatgtaaaatgccgtcaaaagacatatgaaaaactccctctttctcgttaatcctcttcgtaaaacgtccattcaataattatagcatgatttgggacgagtctgaataaattgacttatagagatggatacaccaaaagcaacctttagggcaggaggagtggacgattcaatgaaatggcacgagatgggacaaaccgaattgttaaatataacaaaaacgtccatcgacaaaggtctaacagaaaaagaggccggaaagcggctggaaagacacggaacaaacgaacttcaggaaggggaaaaaacatcggcggtcgcattgtttttttctcaattcaaagatttcatggttcttgttttgcttgcggccacgttgatttcgggtttcctcggcgaatacattgacgccatcgcgatcatcgcgatcatctttgttaacggcattctcggattctttcaggagaggcgggcggaaaggtcgctcgaggctttgaaagaactgtcagctcctcaagtggctgtgctccgggaggggaattgggtgaaaattccttccaaagagcttgtcccgggagatgttgtccgttttgcaagcggagacagaatcggcgccgatctcagacttgtcgagacaaagagccttgaaatagaagaatcggcccttacaggtgaatcgctccccgtgtccaaacaggcagatgcttttcaggcgtcagatgtatcgctgggcgatctgaagaatatggctttcatgggaacgcttgtcacaagggggagcggaatcggcgtcgtcatcggtacgggtatgaactctgcgatggggaaaatcgccgatatgcttgaatctgccgggaatacggcgaccccgctgcaaagaaggcttgaagagctcggcaaaattttgattgtcgccgctttgttcctgacactgcttgtcgttgctgccggcgtcattcaggggcatgatttatacagcatgtttttagcgggagtttcccttgccgtcgctgccatacctgaagggctgcctgccattgtcacggtcgctctgtctctcggcgtgcagcggatgatcaggcaaaagtcgatcgtcaggaagctgcccgcggttgagacgctcggctgcgcgtccattatttgctccgataaaaccgggacgatgacgcagaacaaaatgacggtcacccatgtctggtcaggcgggaagatatggaacgtgtcagggatcggctatgagcctgaaggctctttcagcatgaacgggcgcgatgtgcaagcaaagcatcataaaccgctccagcaggtactattgttcggcgcattatgcaattcatcttcgattatcgaaaaagacggggagtttcgtcttgatggcgatcccaccgaaggggctttgctgacggcggctcgaaaagcaggctttacggacaaatatgttgatgaacattttaaaatcatcgaggagtttccgtttgattcaacgcggaaaatgatgtctgtcattgtggaagacaagagcggcaagcgctttgtcattacaaagggcgcgccggatgtattgatgaagcgttcgtcgcatacgctgacagaagaaaagcgagaaatcttcacaaaggaaaggctcgctgaaacaagcgcggcgctggaaactcttgcgtcacaggcgctgagaacgattgccgtcgcgtataaaccgatcaaagatacagaaaatcccccgctcgaaaaagcggagtcaggcttaactttcatcgggctgttagggatgatcgatccgccgcggcccgaagtgaaaacagcgattaaagaatgccgggaagcggggatcaaaacggtcatgatcaccggggaccatgtgataacggcgacggcgattgcaaaagatctcggattgctgcctccgcgcggaaaggtcatggacggccagatgctgaacgaactctcgcaggaagaattggcggaaattgttgacgatgtttacgtatttgcaagggtgtcgcccgaacataagctgaagatcgtgaccgcctaccaggaaaacggccacatcgtcgccatgacgggagacggagtcaatgatgcccctgcgattaaacaggcggatatcggcatatcgatggggattacgggaacggatgtcgccaaggaggcgtcctcactcatccttgtcgatgataattttgcaacgattaaatcggccatcaaggaaggacgcaatatctatgaaaatattagaaagttcatcagatacttgctcgcatccaatgtcggcgaaattttggtcatgctgtttgcaatgctgctcgctctgccgctgccgcttgtcccgatacagattctgtgggtcaaccttgtaacggacggcctgcctgccatggcgctcggcatggatcagcctgaggacgatgtgatgcagagaaagccgcggagtccgaaagaaggcgtgtttgcaagggggctcggctggaaggtcgtatcgcgcggattcttaatcggaatcgcgacactcggggcgtttatgttcatttataaccgcaatccagaagcgcttgagtatgcacagacggttgcatttgcaacgctcgtccttgcgcagctgatccacgtgttcgactgccgaagcgagcggtccatctttgaccgcaatccgtttgaaaacatttatttgctcggtgcagtgctgtcttcgattcttttgatgcttgtcgttatttattatccgccgctgcagccgatttttcatacggttccgattttaatggcagactggctcctgattgtcggaatgtcggcgattccaacttttttactggccgggtcacttttacaagaaaaaaatag

SEQ ID NO: 26 - protein, 890 aa, Bacillus licheniformis
MKWHEMGQTELLNITKTSIDKGLTEKEAGKRLERHGTNELQEGEKTSAVALFFSQFKDFMVLVLLAATLISGFLGEYIDAIAIIAIIFVNGILGFFQERRAERSLEALKELSAPQVAVLREGNWVKIPSKELVPGDVVRFASGDRIGADLRLVETKSLEIEESALTGESLPVSKQADAFQASDVSLGDLKNMAFMGTLVTRGSGIGVVIGTGMNSAMGKIADMLESAGNTATPLQRRLEELGKILIVAALFLTLLVVAAGVIQGHDLYSMFLAGVSLAVAAIPEGLPAIVTVALSLGVQRMIRQKSIVRKLPAVETLGCASIICSDKTGTMTQNKMTVTHVWSGGKIWNVSGIGYEPEGSFSMNGRDVQAKHHKPLQQVLLFGALCNSSSIIEKDGEFRLDGDPTEGALLTAARKAGFTDKYVDEHFKIIEEFPFDSTRKMMSVIVEDKSGKRFVITKGAPDVLMKRSSHTLTEEKREIFTKERLAETSAALETLASQALRTIAVAYKPIKDTENPPLEKAESGLTFIGLLGMIDPPRPEVKTAIKECREAGIKTVMITGDHVITATAIAKDLGLLPPRGKVMDGQMLNELSQEELAEIVDDVYVFARVSPEHKLKIVTAYQENGHIVAMTGDGVNDAPAIKQADIGISMGITGTDVAKEASSLILVDDNFATIKSAIKEGRNIYENIRKFIRYLLASNVGEILVMLFAMLLALPLPLVPIQILWVNLVTDGLPAMALGMDQPEDDVMQRKPRSPKEGVFARGLGWKVVSRGFLIGIATLGAFMFIYNRNPEALEYAQTVAFATLVLAQLIHVFDCRSERSIFDRNPFENIYLLGAVLSSILLMLVVIYYPPLQPIFHTVPILMADWLLIVGMSAIPTFLLAGSLLQEKN

SEQ ID NO: 27 - DNA, 3625 bp, Bacillus licheniformis
  CDS (501)..(3122)
aagaaggaaaagccgaattaaagcttggccatgccgaacaaattccttatccggatcgttcttttcataaagtattttcagtccacaccatttatttttggacggatttcaaacaggcattaaaagaaatttaccgtgttttacaggttgacggcacgctgtttctcgctgtgcatctggaagggcaaatgaaaaaatcgaaaaaaacaaaaggcttttccttatactcagaagagcaaatcaagcaactgcttgaggaaagccatttcagagacatcacggtacatatgaacaaaaattactgctgcatttctgcggtaaaatcatgaactttgtatgatcatccctttcaatacggaagggattttttatgtttgatagagttgaaactggatcttaaatatcatatttttgatttttaaagaaaagtattccattaacatagcaaacatggtttaatatcaaagtgaacgtttttactatattttccggaggtatttatgaacaaaaggatcgtgaaaagttcaattgttttctttctccttgccgcattaatttttggccagctgcctttaccgaagacaatggcagcagaagacagcgttccgaataacgaaaccacattgaccagcgcgtcccctgttgaagcttcgtttcaaagcgatgacgaggtgcattggtataaagtcaatccttcaaatcaggaaatcgcaaactatacgcacttccgcgtcaaattgaaatcagatgcagagctgaacatttccgtctactccagcctggaaaatgcaactggtcatcaaacgtttgaccgatacaacggctactcctatgaaaataatcctgctttaatcgattttccgattgcctggaaaggtccttactacataaaagtagaaaatcaccatgatgaggaaaacgaaaccacttcaattacagatatttcttacaccatcagctatgaaggcgtcaccctgcctccgtcaatccaagaggcagaagaagagtgtccggcagaattaagcgtttccgaaagggaaacaggcaagggcatattaaaacagttaagaacgatcagggatgaagttctttcaaaaactgaaaaaggaaaagagctgtcttccctttactataaagcagctccattcatcagcgcaaaaatgctctttaacaaatcgatgagagacagtgtctacaaagacctggtgcagctgaagccgctgtttgcagatgtcgctaaaaacggacaagtgagcgcatactcgattacgaatgatgatcaaaaagcgatcagtcgcctgtacgaaacagctcgcgcgtccgttcccgagccgttgaaaaaacagctggatcaagtcgcgaaagacatcggcatcgaacaattaacaggcagcaaagtatcggctgtgcttgaaaaagcggggatggcgacagcttcatcaagcgcgcccgaaaaccgttacatcgtaaaattgaaagaaggcaaaaaaccgggatctttcaaatctaaagcccaatcatccggcgtccaggcattagagcccctcggtaaaagcaaaacggcatttaaagatatgtacgttgtggaaatgaaggaaagccgttcttccggattcaaagcggcggcaaagcaatatcaggcggcagcctccaagatcgccaagatgcctgaagtggaattcgtcgaacaggttcagcaatatgaagcactgtcaagagacacccaatatccatatcaatggtcgctcaaaaataacggcaaaaaccgtgctgcgaatgctgacatacaatttgaacagcttcagaagctgatgaaaggcaaaaagctgaaagatacagtaatcgccgtcgttgacacaggcgttgatcatacccttgcggatttaagcggcagcgtcaaaaaagacgaaggctataactatgtcggccgcacggcggatgcgatggatgacaatggccacggcacacacgtgtcaggcatcattgcagccgcgcaagacaaccatttttcgatggcgggaatcaatgcttatgccaaaattctgcctgtcaaagtgctggattcttcaggcagtggagatacggaacagattgcaaacggcatcatctatgccgccgaccacggtgcaaaagtcatcaatttaagtcttggcgggccatacagccgggtgatggaatatgcgcttaaatatgcggcttctaaaaatgtgacgatcgttgccgccaccggaaatgacggagtatcggagatttcctaccctgcatcttcgaaatatacgctttcagtcggggcgaccaataatctcgatcttgtctcggactactccaattatggaaaaggtctcgatatggtggcgccgggaaccgatattccaagcctcgttccggacgggaatgtcacttatatgagcggaacatcgatggcggcgccgcacgtggcagctgcagcaggacttcttttgtcacagaatccgtccttgaaaccaaagcaaatcgcaagcctattgaccgagacgacagcagatgtggcatttgaagagcaggataatccaaacccggattatgacctggatatagaaccggctgcacaaattcccggatatgacttcgtctccgggtggggaaggctgaatgtttttcatgcagccagcgtttttgagctgaacatgaaggttcatcccgttttaaaccgccatacggcagtgacaggcacagccaaaagcggtgtgacggtcaaaatcttgcgagggaagcaagtattggggacgggcacggccggaaaatcaggcgcgttttcagtgaaaattccggcccagaaggcggggcaagttcttcatgtcgcggcatcgggccatcaggcggaaacctcgctcagaaccgtcgtggaaaaagcgccgaaaaacccgtccgtcaaacgcatcacgaacaaagatactgccgtaacgggtagaacggcagccggctacacgatcaaagtgaaaaacgcgtacaaaaaagtgatcgcgcaaggcatagcggatgcatccgtgagcgttaaagtgaaaatcaacaagcaaaaagatatgccgttttgtatgtctccgcatctgctgatgaccacagagaaagcggcgatgtcaaaatgacggtggctgacgtcatcccgccaggcgccccgaaagtttatcaggtttccgataaaagtacggtgattcagggaaaaacagaagcaaacgcgcaagtcagcgcaaaagctaaaggaaagacgatcgcttccggcaaagcgaacggaaaaggtgaatacaagctgaaaatcagcaggcaaaaagccggaaccgtcatcggtgtaacagcaaaggataaagccggaaatgtcagcaaagcgacagccgtcactgtgcttgacaaaaccccgccgtctgcgccgaaggtgaatccggtgacaaacaagagcacggccgttaaggggaaagcagaagcgaacgccgccatcatcgtcaaatcaggaaagaaaacgatcggaaccggcaaggccgataaaaaaggcgcgttttttgtcaaaataaaaaaacaaaaggcaaacaccgttttagcggtcactgcaaaagataaagccggcaatacgagcaaagtgagcaaaataaaa

SEQ ID NO: 28 - protein, 874 aa, Bacillus licheniformis
MNKRIVKSSIVFFLLAALIFGQLPLPKTMAAEDSVPNNETTLTSASPVEASFQSDDEVHWYKVNPSNQEIANYTHFRVKLKSDAELNISVYSSLENATGHQTFDRYNGYSYENNPALIDFPIAWKGPYYIKVENHHDEENETTSITDISYTISYEGVTLPPSIQEAEEECPAELSVSERETGKGILKQLRTIRDEVLSKTEKGKELSSLYYKAAPFISAKMLFNKSMRDSVYKDLVQLKPLFADVAKNGQVSAYSITNDDQKAISRLYETARASVPEPLKKQLDQVAKDIGIEQLTGSKVSAVLEKAGMATASSSAPENRYIVKLKEGKKPGSFKSKAQSSGVQALEPLGKSKTAFKDMYVVEMKESRSSGFKAAAKQYQAAASKIAKMPEVEFVEQVQQYEALSRDTQYPYQWSLKNNGKNRAANADIQFEQLQKLMKGKKLKDTVIAVVDTGVDHTLADLSGSVKKDEGYNYVGRTADAMDDNGHGTHVSGIIAAAQDNHFSMAGINAYAKILPVKVLDSSGSGDTEQIANGIIYAADHGAKVINLSLGGPYSRVMEYALKYAASKNVTIVAATGNDGVSEISYPASSKYTLSVGATNNLDLVSDYSNYGKGLDMVAPGTDIPSLVPDGNVTYMSGTSMAAPHVAAAAGLLLSQNPSLKPKQIASLLTETTADVAFEEQDNPNPDYDLDIEPAAQIPGYDFVSGWGRLNVFHAASVFELNMKVHPVLNRHTAVTGTAKSGVTVKILRGKQVLGTGTAGKSGAFSVKIPAQKAGQVLHVAASGHQAETSLRTVVEKAPKNPSVKRITNKDTAVTGRTAAGYTIKVKNAYKKVIAQGIADASVSVKVKINKQKDMPFCMSPHLLMTTEKAAMSK

SEQ ID NO: 29 - DNA, 2185 bp, Bacillus licheniformis
  CDS (490)..(1686)
cgatttcctgaaaaaacgtaaacgccgggtagacgccgccaagcggaatgccttgatcaggaacgagccctttcaaaataaaatcgatcgctccgaactgaacgagaataaagccgtaaaaaaacatgacatggatgatgccgctttttttatctttaagcagtttcttttggccgaacacgttctcccatatcttttgaaggcgctccttcgtccgcttatcaaaatcctctttttgtccgagcctgatgtaactgattctcgttctgatcaaatagacgaacagataaacggcgtaaacggttacacctaaaaacgcaatgaaattcaacgacagcaagacattcatcagctgctccccctttcatttccccaaccttaaatccccttgaactacctttatcttaaataatgaatgagtgttcagtcaatatattttcataaatgcaggaaaatagggggacactattctttacacgaaaaaagggagtgtcttcattggtgccgcttatgattatggtatgttttctcatcctgcttcttgcgctcgatttccattttggccgcaaagcctttgagaagaaagcctacgagcccgttttttcagagaagaaaagcgatattgaactgattcataatggagaagacttgtgtgagcggctgctggatgacatccgccaggccgaatcgtcggtgcatgtcatgttttatattgtgaagaacgatgacatcagccttgaatttttgaaggtgctgaaggataaagcgaaatccggcgtatgcgtacgattgctgatcgaccggatcggcgcgatgaaggtgaagaaaaaaacgctctccggcctgaaacaaagcggtgtgcacgtttttttcgccaacaagccgggcttcccctatttcttttaccggctgaatgcgaggaatcatcgaaaaatcgccgtcatagacggaaagatcggctatgtgggcggatttaacatcgcgaaagaataccttggtaaaaaagcggaattcggaccgtggaaggattaccatttgcgaatgacgggagaaggcgttgccgacttgcagcacatttttatatcggacttcaaaagagaagcgccgcaggcaaagccggccaacagcgtatttccgccgctgcagcaaggagctgtcacccatacaacccatgcgacaaagggattttctctagaggaaaaatacatttcatttatcgaacaggcaaaagaaagaatcatgatttgcacgccgtactatattccgagcccggctttgcagcaggctgttctctcagccagggaaaggggcgtgatcgtgtcggttctcgtgccgatgaaacccgatcatccgcttgtcaaagaggccgcctacacgcactttccagcccttttaaaagcgggctgctatatttaccggtactacagaggcttttatcatgcaaaagcattaatcgtcgatgaccggcatgtgatgatcggaacatcgaattttgacaacaggagcctgtttctcaatgatgaagtgaatgtcgtcatccatgataaagactggacaaagcaattcttcgacgtcgtcaaggaaagcattgaacacgccgagcttctgacaaaggagcggtatgcgaagcggccggtgatgcagcggcccgtcgaatggctggcgaaatcgatttcattctttttataaaacgtacgtttatcctgcatgacatgcgggtaacatttcaccaaagtgatgattacatacggaggggatgtacgatgaaccaagcagagtcgattaaactccgcgcccaatcgatgacgttaaaaaacttgattgagctgtacaagctttgccgctcagccagacatcagctatatatatgctcaagaaaaacgatgtgcaaaatcaaagatttaattgagctggaaatgttcagaatggccaatcgcgaaaatgagtgcctgattgtcatcgaagggaaaatggcgcaggaattagtaaaaaaagcacaatcgattctttctgacgctcaagttcaataagggaaggcggaagttcttcctttgcgagacgcctcctcaccaaatcaagaaaaaatcccccgttcaatggacgggggattcgttttacattttttcaggcgctgatacgccgatcagcttgagggcattatttaatgtgatttgcgttgctttca

SEQ ID NO: 30 - protein, 399 aa, Bacillus licheniformis
VSSLVPLMIMVCFLILLLALDFHFGRKAFEKKAYEPVFSEKKSDIELIHNGEDLCERLLDDIRQAESSVHVMFYIVKNDDISLEFLKVLKDKAKSGVCVRLLIDRIGAMKVKKKTLSGLKQSGVHVFFANKPGFPYFFYRLNARNHRKIAVIDGKIGYVGGFNIAKEYLGKKAEFGPWKDYHLRMTGEGVADLQHIFISDFKREAPQAKPANSVFPPLQQGAVTHTTHATKGFSLEEKYISFIEQAKERIMICTPYYIPSPALQQAVLSARERGVIVSVLVPMKPDHPLVKEAAYTHFPALLKAGCYIYRYYRGFYHAKALIVDDRHVMIGTSNFDNRSLFLNDEVNVVIHDKDWTKQFFDVVKESIEHAELLTKERYAKRPVMQRPVEWLAKSISFFL

SEQ ID NO: 31 - DNA, 2908 bp, Bacillus licheniformis
  CDS (124)..(2058)
ttgccccttcccttgtggctgcaatgagacttgtttaacaacaggtctcttttttttatgattttatgaaacaatatgcagcgtcgtttgtctataaagatgaggccttaatttgatgtaaaggaattgtggacattgatcgaactatttagtgattatgtgctccattttgaacgttattttgttttaagcagacagagcatgcttgtcattcagtggtgtgtgacaggccttgtccttttgtatgccgtgtcatttcatccaaaagtgtgcaggcggcgcctctttttttatgcaggcatcgttctcaggctgatactggttggcgccctttcgtttgaattggctcaccaaatgaaagccgctgagttttcaaacctgtacatagacgaacaagatgcgcttctgccttttatgcagtttttgctgttcggctatattttgcttgtctcttttcattatatgatgacactcgcggaaaaagggggcaaggggctgttttttgcatttgacattgcggtgatggcgatgccgcttttccaatcgctgttcagctttgccgcctatttgaaggaatttggagcggaggagcttgaagaattgccgctcgttctgttgttgattgtcggaataccgggactgatgatctgcttgttttttcagctttattggaaaagaaaccgttacgttctccttttgattttttatattgtgacgatcggcggtttcttcatcaaaaagcttggatacgaattttttccgctgaacgtatttctgacaatgatcggttttcttatgacatatcacttgctgaatgactcgagaaagcctttgttgatggtgaagcgtgttttagccgcgggcaccgccgtatttttcacgcttcacctcaatcctttttacaatttggcggatgccgcttttacaatctcacacccggaggtttcagacgtggttgatgccaattttcggcctgtttcggttaaagaagcgaagcagactgtcagctcgttttttccgacagagagctttatctatttgtcagctaccaaccaggattttcataacgtttatcatttcaaaacgaaagattacgatgcggacgttgacggctggacgggaatgatcaccaattatcacaatcaaaaaaagcctagcgggaatatcctgtccggtcaggcatatatcaagcggtcgaagcaatttctaagggaacacggccgcgaacttgacaaacaaatcaaggcaaaggtcagccgtgatgacggcgaagctactgttgaattttaccgtgaaggcgaggatcctgaattaagcacaatgtggtttacttggcggaaggagactctgatgggattccatgaggacgcgtctgtttacagcttagaaagcgtgaaccaagcccgcgtttctggtgaggatatcgagcggggagttgaagccgtctatcgtaagctgggcatacccgtctcatcttatcggctgacagatattgatttattattcccattcagcctcaactcggcatccatcaacataaagacaagtgacggaatggggatggagttccaccctgtaacaggtgcattaacggctatttcgatcaaatctgaaagcgccttgccttatcgcggacaagagcttgaaaaacgcttgctttcattatttgatcaagacatttccaatctgaaaagggtggagttagaaaaggatctgatagaatttcagaaaaaagaaagcgatgctgtgttaaatacggtctggaccatgacgaaacatgaagagggagcttatctgacggtgagaaaaaactttcaaaaagcagatgaaaaacccccctacacgtatgcagacggggaaaaagcttttcagaaagtgtctgaacgctatcaaaaagggctggtctatcataaacggacgaagcttgtaatcgtttcagacggggatcaaaagagccgttatgcgtggcttgtcatcatccagccgttcggctcaaatgaacatgacgcatacttggttgatgccgagacagatgaggtgaaacattttgatgacaaatgaagaaaaaaaagcggtgtttatcgatttgtatgagctctatcaagaaagtgaactggaagaggaaacgatgatctggatgaaagagcatgagcagttttttcaggatcaggctgaagcggcagcagccggtaatagagagctccccggcatgcaaaaaacagatgatcatcagaagctccttcatatcaagatttttgtttactcgttatatggtgctttcctgctcctatcgatttggatgacggtgtggttttttttctaaatggctcacaataataaacagacgattgaagaactgtacagggaatattatcatgacatcatgtactatttgtacaggcgaacccatcagcttgagacggcgaaagacctggcgcaggatacgtttctaaaagcttttgcgggcctggagtctttcaggggccattcctcgatcaaaacatggctgtatacgatcgcacatcatacgtttatcaactggtacagaaaagataaaaaaatccaattttccgacgtggcggcctgcggcgatatggaacagcacacatttgaaatgcctgagcgccatttggcaaacgccataatgcaggaagagctgaaacatcacattgaccggctgaaagaagattaccagactgtcctcattttaagagagtttcaagagctgtcatacgaggaaatagcggaagtgctgaattggaaactgtcaaaggtaaaaaccaatcttcaccgggcccgcctggagctgaaaaaaagcttggaaggcagggaggtttaacaatatgaaatgccatcttgtaagagatttactgcctttatacatagaaggcgattgcagccgcaaaac

SEQ ID NO: 32 - protein, 645 aa, Bacillus licheniformis
ELWTLIELFSDYVLHFERYFVLSRQSMLVIQWCVTGLVLLYAVSFHPKVCRRRLFFYAGIVLRLILVGALSFELAHQMKAAEFSNLYIDEQDALLPFMQFLLFGYILLVSFHYMMTLAEKGGKGLFFAFDIAVMAMPLFQSLFSFAAYLKEFGAEELEELPLVLLLIVGIPGLMICLFFQLYWKRNRYVLLLIFYIVTIGGFFIKKLGYEFFPLNVFLTMIGFLMTYHLLNDSRKPLLMVKRVLAAGTAVFFTLHLNPFYNLADAAFTISHPEVSDVVDANFRPVSVKEAKQTVSSFFPTESFIYLSATNQDFHNVYHFKTKDYDADVDGWTGMITNYHNQKKPSGNILSGQAYIKRSKQFLREHGRELDKQIKAKVSRDDGEATVEFYREGEDPELSTMWFTWRKETLMGFHEDASVYSLESVNQARVSGEDIERGVEAVYRKLGIPVSSYRLTDIDLLFPFSLNSASINIKTSDGMGMEFHPVTGALTAISIKSESALPYRGQELEKRLLSLFDQDISNLKRVELEKDLIEFQKKESDAVLNTVWTMTKHEEGAYLTVRKNFQKADEKPPYTYADGEKAFQKVSERYQKGLVYHKRTKLVIVSDGDQKSRYAWLVIIQPFGSNEHDAYLVDAETDEVKHFDDK

SEQ ID NO: 33 - DNA, 1712 bp, Bacillus licheniformis
  CDS (501)..(1211)
aagaagcagatcaatttggaaaaacagcttctgcgcgaactgtctttggaaaaaatgctgaattctgcagaggaatgctttgctcctctttttcactttttttctaagcatacggatatcttatatgacggctgcatcgactttgccattgaggcatatttgctgggagccgagtacgggaagttcggctatcacggagaacccgttcatcgagcgatgatccgctcagaaaaagaagaaaaacagctactgcacgagctttatgaatatgctgtcagctggtctgaggcttttaatgttcaagctgcttatgaaccgctctattatgcctgcgaatacttcatccaaagctggtggaaggaaggcttcagccagcgggaaagacgctttaagcttcggctcagataaaacaaagttttatgaaaaagtgaggccaagcttaatcatatttcctttccttgtcccatatcttgtagtaaggacgagcgggagggaaagggatgaagaaaaaaataaaatggctcgggtttttactcggctttgtcgttttattatgtttatttcaatatcaattcaacaatgatgattcttggcggtcatggaatcttccgctgagcggcaaaatcatttatattgatcctggacacgggggcgccgatggaggggcatcaagcggtgaactccttgaaaaagacgtggctcttgaagtatccctaagaatcagggactatctccaggagcagggcgccttggtgatgctgacgcgggaggacgatcatgatctcgctcctgaagaaacgaggggactcagcagaagaaaagctgaagacttgcggaagagggtcgatatgatcaacaattctgaagccgatctttacctcagcatccatttgaatgcgattccttccgcgcgatggagcggtgcgcaaagcttctattacgggcaatatgaagagaatgaacgggccgccaagtttattcaggatgaattaagacataatcttgaaaacacgacgcggaaggcaaagcggatacacggaatttatttgatgcaaaatgttaaaaagcccggggcccttgtcgaaatcgggtttttgtctaacccggaagaggcaaaacagctggccaagcccaaatatcaggacaaaatcgcagcatccgtttataaaggcgtattgcgctactttacagaagacagagaccctcctgaataagagggtttctttttgtgtcaaagacactataaggaaagatatgctatacttattttgtaaacgaatacaacaaagggtgagatcaatgttgcgagaagacgatgtaaaaaagatagtcggcgatttggacgagccatttcttcacaagccgctcagagagctggatgccgtaaaagaaattaaaataaaacccgaaaaacggcacgtcagcgtaaaggtggcgctcgcaaaaacgggatctgccgaacaaatgcagcttcagcaggaaatcgtcatacggttgaaagaagccggtgcagagacggtcggcctgcgttttgaggagctgcccgaagaagtcgtaatgagttatcaagagtctgccaaagggcaggatcaatctctgctgaatagtgaaaaacagcctgtgtttttagctgtggcaagcggcaaaggcggcgtcggcaagtcgacggtgtcggtcaatttggctgtgtccctggcgcgaatcggaaagaa

SEQ ID NO: 34 - protein, 237 aa, Bacillus licheniformis
MKKKIKWLGFLLGFVVLLCLFQYQFNNDDSWRSWNLPLSGKIIYIDPGHGGADGGASSGELLEKDVALEVSLRIRDYLQEQGALVMLTREDDHDLAPEETRGLSRRKAEDLRKRVDMINNSEADLYLSIHLNAIPSARWSGAQSFYYGQYEENERAAKFIQDELRHNLENTTRKAKRIHGIYLMQNVKKPGALVEIGFLSNPEEAKQLAKPKYQDKIAASVYKGVLRYFTEDRDPPE

SEQ ID NO: 35 - DNA, 1988 bp, Bacillus licheniformis
  CDS (501)..(1487)
ttactgccacctcccggaaaatttgattcaaatgacctgttgggttccgttcattaaaggaccttattaatgttacaacatggtataaatgagttgaatgggaaaaatgtaccgtgaacaaagaatctagttgagcggtggagcaggggattccttattatgactgcgattttgcacatttctccattttcctgcaaggtcaaaagacatagttcttaagttttggatttttggtgtgtttattttttgtttcacaaactttaaggtaattttaagaaagaggcgatcttgccaaccctaaacagggtttttcgaacagaatgtcaaatagattagatatttcataagaacaagggggaattgtctgtttgtgatgaataaaggaggacgggcggaatttctgtcaggatgctcagctgggttcttagaaaaaaatgcggctaaatatatatttatagattgtaaacgctgtcttgtcctcgaccaacagggggatgaagatgaagaagctgttagttgtttatgccgtgatgctctgtttgttttttctgtatgtctacgactactcccggggcgataaagccggttctgcagaagaaagcaggaggcctgcggccgcaggcagtctgtccgaaaaatacgtgatggtcacgtttcaatcgggaatcgaatattggaagagcggtctgaaaggctttgaggatgccgcgcagcttttcaacgtctctgtcgagtatcggggggcggcccattatgatgtccatgagcaaacgaccgtcctcgagcaggtgattgcaaaaaaaccggcgggaatcgctgtttcggcaataaacccaaaagctttaaaccctgtcatcgacaaggcgcacgagcagggtattccgatcgttttatttgattcagacgccccgctcagcaaagcttctacatatatcggcacaaataatatggaagcgggtgctgtggccgcaaggcgaatggccgaatttttgaatggaaagggagaaaccgcggtcattacccagccgcagcagtacaatcatcaggaaaggacgaagggctttgaacaaacgatcaagcaaaaatacccgaacatgaaggttgccgcggttttggacggaaaaggggatgagctgacgtcgaaaaaagaagcggcgaagattttggaggaaaatccgtccatcaaaggaattttcacgactgaagccaatggagcgagcggcgtggcccgtgctgtgaaggaggcgggacttgaaggggaagtatgtatcatcggctttgataaagacaagaaaacgctggacggcatcaaaaacggatcgatttccgcgacaatgagccaggacacatggcaaatgggctattggtcgctgcacatgctgtttttctcaaatcaccatctgaagcatgaacgcccgcttccggccgcaatcgacacaggcattaccatcataacgaaagaaaatgtggcagcctattatgcgaatgattaaacgtttgatcaataatgcgccgatccgtcataagctgatcagccttctcttgttaatcagcatgctgccgacgatcggcctgggcattttatcgggatgggccgttgaaaatattattgaaaaacaggtgatcgaccaaacactgcagctgatcggcgaagtgaacaagacggctgaagtgtatgtcagccacatgcagaacctgacatatttaatatcaatgaatgaagaaatggaagcgttttttagtcataaaaaggaggatggagaggcggattataagcgaaggacgtttttgcagggcctgacttctttatattccgaagcagcgggtattctcgttgtcaatgataagggtgagatgatcagcaatgagatgtatgaacgcacgccgacagatttgacaaaagaaccatggtatcaggcggctctcgacaatgaagggattttcaagatgatcgggaagcctgtcaaccggaatatcagaagccatgt

SEQ ID NO: 36 - protein, 329 aa, Bacillus licheniformis
MKKLLVVYAVMLCLFFLYVYDYSRGDKAGSAEESRRPAAAGSLSEKYVMVTFQSGIEYWKSGLKGFEDAAQLFNVSVEYRGAAHYDVHEQTTVLEQVIAKKPAGIAVSAINPKALNPVIDKAHEQGIPIVLFDSDAPLSKASTYIGTNNMEAGAVAARRMAEFLNGKGETAVITQPQQYNHQERTKGFEQTIKQKYPNMKVAAVLDGKGDELTSKKEAAKILEENPSIKGIFTTEANGASGVARAVKEAGLEGEVCIIGFDKDKKTLDGIKNGSISATMSQDTWQMGYWSLHMLFFSNHHLKHERPLPAAIDTGITIITKENVAAYYAN

SEQ ID NO: 37 - DNA, 2785 bp, Bacillus licheniformis
  CDS (501)..(2282)
caaaattgccgccggcctatcttgtgacccgctgggaagaccctgccgtttacaagttcgcggaaaccgcaaacaaagcgaaggcaacggaatttgtgtatcaagtcaacagcttatctcacagtgatttaaacaagatgttcggctctccagatgcaccggcagaagcgcagaatctgacaaaagcggttatggcgtttttagagaaggaaaataaatagatcaaacggccgactcggcttcctacatgtacttgctgaaaggatataaacagctgttaaactagcagagaaaggccgaaaatgttaaattcggcctcttctcacacttggcacccccttactcataagacatcgatctgaaaattcccaaaatataaacaaaacattaataaaatcaagccatttgattaacaaatttacgatacgatcatatagaacttgatgattgggaaaagcattttgagagaagattaagagcaagggagatatgatgtgagaatgaaacgattaaggatgaggaagcatttactgatagctgtctgtactttggcacttcttctaagttccccgattgtaagcgatgcgagcccggcaactaaaccaacaactgcagattcgccgcaatcttccggatttttcgtagaccattacaaaaataatatctctgccaatacgacggcggaatccaatcctgtcatcggcctgctttccgaatttaataaactttggactcccggaaagacatggaataccggtactaaactgaacagcagggtgctggatgccaacattcaaaaagtcgtggatattgctgaacgccgcacgatgcttgaggaaaatgctgcctattttgatgatcggcggagccagagctacagtataattgacggcctcggcaagcttgccggcgtctatcgaatgaacgcgggagcgacgacaacgatcaccagcattccggcagatgcctcgattagaaaatacaatgatgaaggaaccaattcgggcagcaccagctctgaacttggaaatgtcgtaagtttggtcaatactttacgcggcaactattcttcatcgaatccggctaaaagctatttcaactatccccgcccgtttcgctggaaagacaattcgatcattgttccaacgcttatccccgtcatcaatcctgatccgaacaaagacggaggttttccaagcggacacacgaacgccgcatatctcagcgcttttgctatggcctatgcgataccggagcgttatcaggagctgctgactcgcgcttcagaactcggtcataaccggattgttgccggtatgcattccccgctggacgtcatggggggacgagtaatggcaacagctttgtctgcagcaatcctgtctgaccccgcaaatgaaagattgaagaaaacggcttttgatgaagcccgccgtaaattattaacgcaaaccggtacagctgaagacagatacagcgattatgagaagaataaaaaacaatatacggaacgattgacatatggatttcgacaaatgaacaaaaccgccaaaccaatggcagttccaaagggagccgaagtcctgctggaaacacgttttccttaccttgacaaaaagcagcgccgttcggttttagccactaccggtcttccggccggctaccctgttcttgatgatcgagaaggatggggaaggcttaatctcttttccgcggcagatgggtatggggcttttaccaaaaatgttaccgtgaccatggattccgcaaaaggcggcttccatacagccgatcgctggcgcaacgacatctccggcaccggaaagctgaccaaaaaagggacaggcgctttgaagctggaaggggataatacatattccggcggtacacggattgatcaaggaacacttgagggcggttcggagacagctttcgggagaggtgatgttgcactaaacggaggcatccttaaggaagatgcgccgggaaaactgatcatcgaaggagactacaaacaatctgctaaaggaatacttgaacttcagctcagcggcaaaaaagatcagttgaaaattaagggaaaagcaagattgaaagggacattgcgtctcaattttacggacaattacgtaccggctgacggatcggcgatcataaccttccgcaagcgtcatggatcattttcttccgtcgagaccagtggattgccaagcaagtataaagtgaagatcatctataaatccaacagtattcagttgaaagttgagcaaaaggggagaagctgatctgcaagaggattcactcaaaagctgcaagctggcgcatactgccgccagcttgcttttagttttgatgaaatcacagccagaatggctgtacatcttgaatggggaatcttaaaaaatagtcggcaccattcccccgtccatacggatcggggaccctttaaatgcggatgcatagggactgcatacaaatgcagccagtctgccgatttcaataggcttgataaatcgctgtatttcggattgaggcaggtttgtcgtcataaatttcttctctttttctgaaaaagtcatcccttcatcggggtacattccctcaatgatttgcttcacattctcagagagcgtcggccccggcatgatcgtattgactgtcacttctgttccgattgttaattttgataagctttttgacaatgataatagcattgattttgtcatacaatactgaggcatctggcctgaaggcatcatcgcttcttcacttgcgataaagatga

SEQ ID NO: 38 - protein, 594 aa, Bacillus licheniformis
MKRLRMRKHLLIAVCTLALLLSSPIVSDASPATKPTTADSPQSSGFFVDHYKNNISANTTAESNPVIGLLSEFNKLWTPGKTWNTGTKLNSRVLDANIQKVVDIAERRTMLEENAAYFDDRRSQSYSIIDGLGKLAGVYRMNAGATTTITSIPADASIRKYNDEGTNSGSTSSELGNVVSLVNTLRGNYSSSNPAKSYFNYPRPFRWKDNSIIVPTLIPVINPDPNKDGGFPSGHTNAAYLSAFAMAYAIPERYQELLTRASELGHNRIVAGMHSPLDVMGGRVMATALSAAILSDPANERLKKTAFDEARRKLLTQTGTAEDRYSDYEKNKKQYTERLTYGFRQMNKTAKPMAVPKGAEVLLETRFPYLDKKQRRSVLATTGLPAGYPVLDDREGWGRLNLFSAADGYGAFTKNVTVTMDSAKGGFHTADRWRNDISGTGKLTKKGTGALKLEGDNTYSGGTRIDQGTLEGGSETAFGRGDVALNGGILKEDAPGKLIIEGDYKQSAKGILELQLSGKKDQLKIKGKARLKGTLRLNFTDNYVPADGSAIITFRKRHGSFSSVETSGLPSKYKVKIIYKSNSIQLKVEQKGRS

SEQ ID NO: 39 - DNA, 2009 bp, Bacillus licheniformis
  CDS (501)..(1526)
ttattaccaataaatatcctagtgcagaatctattaagattacgaaaatctcaagcctgaccctgagcagcgcaaaaactgccggtcagcggccgaaaacagcagaggtgaagttttcttactttgttaaagaaaaatcaaatggctatgttctatcaaacggaaaactttcttaaaaaacagcgattatttccgtgacgacgactcaattaagatcgatgctgggcggcatgaatatgaagagcacgtatgcttctgtatccagcaatacgaacgcttttactctcagcggtaaaggattcggacacggcatcggcatgagtcagtacggatcaaatgccagagctgctgccgggcacgattacaagaagattttaagtttctactatccaaatacgactctatcaagctattaatagagtttgaacaggaagcagcagtgcctcctctgttcatgttcatgggaaaacataacatttacatttttggaggttatttttttgaaggtctttcttaaagctgtacctatgttgtcgttacggttctttttgtttgtgcctaatgtatttgcggccaactctgtcacaagattggacggtgcaaaccgatatgaggttgcggtgaacgtttccaagcaggggtggacaagtgcaagcactgtgattgttgcaaatggaaaggcatatgcagacgtcctttcagcgactccatttgcctatcgaaacaacgcgcctgttctattaacggaagcgtctaaactgccaacggccactaaaaaccgaatcagtcaattaaaacctagcaaagtgatcgtaatcggcggaaccgtcagcgttcaaaacggtgtcgtaagcgagatcaaaaagcttggtgtgtcatctgtcgaacgcatcggcggagcgaatcgctacgaggttgcggcgaatattgcgaataagctgccgagcaattcgaaagctgtcatcgcaaacgggacggcctatgctgacagccttgcgatcggcgcatatgccgcgagaaacggcatcccgattcttttaacatcgtcgaattccataccgacagcgacaaaaaatgcgatgaagagcaaaggaacaacatcgaccattgtcgtaggcggtgaagtcagcatctccagcagcgtttacaaacagcttgcttctccgacgcggatcggcggcagcaaccgctatgaagtcgcggccaatgtcgtcaagaaatattattcttctgccaagaatgcaatcatcagcaacggctatgcgtatgccgacggattaacaggatctgttctggcggctaagcaaaaccgtccgatgatgttcacgaatgcatcatctttgccgacaccgacaagagaagtgatcggttccaaaaacatgacgacgtttactgtgcttggcggaacggtttctcttcaatccaatgtcgtgtcacagctgaagaatccgatcgtcggcaaaaaaatcttcattgatgcagggcacggaggtacagacagcggtgcccgtcggcaacggtttatatgagaaaagcgtgaaccttgatgttgcaaaattaattaatacgaaactatcaaacggcggtgctctgccaattatggcgagaacgaacgacacttacctgacgctcgcacagcgcgtgtcaaaagcgcagtcaaatcatgcggatttgtttgtcagcatccatgcaaactcggcaacgccagctgcttccggaacagaaacctactattatacaacatatgaatctgccaacagcaaacggctggcaaccgagattcaaaaccgtctctatgttgcattgaatacaaaaaaccgcggtgtaaagatcggcaacttccatgtcatcagggaatcaaaaatgccaagctgccttgttgaacttgcgtttatcagcaatgtaagcgatgcgacaaaactcaaaagctcgacttacaaagaaaaaggcgctaaagcgatttacgacggaatcgttgcttactattaaaatataaacagaaaactcgt

SEQ ID NO: 40 - protein, 342 aa, Bacillus licheniformis
LKVFLKAVPMLSLRFFLFVPNVFAANSVTRLDGANRYEVAVNVSKQGWTSASTVIVANGKAYADVLSATPFAYRNNAPVLLTEASKLPTATKNRISQLKPSKVIVIGGTVSVQNGVVSEIKKLGVSSVERIGGANRYEVAANIANKLPSNSKAVIANGTAYADSLAIGAYAARNGIPILLTSSNSIPTATKNAMKSKGTTSTIVVGGEVSISSSVYKQLASPTRIGGSNRYEVAANVVKKYYSSAKNAIISNGYAYADGLTGSVLAAKQNRPMMFTNASSLPTPTREVIGSKNMTTFTVLGGTVSLQSNVVSQLKNPIVGKKIFIDAGHGGTDSGARRQRFI

SEQ ID NO: 41 - DNA, 2044 bp, Bacillus licheniformis
  CDS (469)..(1566)
gggtttgccgttgtagccggcgaggtgaaaagactggctgaagaagtgaaaagctctgtcggcagcatcaccgaaatcgtcacggcgattcaaaccgaaacatcttccatggccggtgatttaaaaaccggtttttcagaagttcataaaggaaaaaaccagattgagacttccggccgatacttttcagagattaaaaataaagtgacggatatggctggccgtgtatcggacatttcggaggcattatcgcatttcagacgttcaagcgaggagattaacggctcggtcgagcatatcgcggcgatttccgaagaaagcgcggccggttctgaagaaatttcagcgtccgtacatgagcaaagcggctcgattgaaaagatggacgaaagcgcaaggcttctgggagagatggttgaacggatgaatgtgatgatcaaacggtttaagctctgatgccgatacagaatggggggttttaatgttgtcgatatatgtgaaaagagggctgttggcacttgcgctgttcagtctcctcacagctgttgccgggtgctcattcaattctgcttaaaaaagcgccaaccgttaagaaaaagtaaagctgattgccgactccgacaaattgtacgtcggttttgccatcgatacgctgaaggaagaacgctggtacaaagatcaagaagcgttcgagaaagaagttcaaaacctcgggggggaagtcaagacgcttgccgctcacggaaatcaagaagttcagattcagcaggccgagctcttgatcagcgaaggcgtcgacgtgcttgttgttgtaccggcagatgcggatgccgcggcggagatcgtgaaaaaggcgcacagcgccggtgtaaaagtgatttcgtattaccggctgattcgaaacgcggatgtttattattacgtttcattttatcacgaaaaggtcggggaactgcaggcggaagcgattgtaaaaaaagcgaagaaaggaaacttcgtatatatcggcggatcgtctctttacaacaatgcggtcttattccggaacggcgccatgaaagtgctcgaaccgttgaagcggcagggtcaagtcaagctcgtgctttacgaatatacgaaagactggctaccagaagaagcgaaaaagaacatgaaaaaagcattgaacaagacgagagatatcgacgccgtgatcgccgccaattacggtacggctggcggggtgatcgaggcgcttcaggaggcgggcctggccgggaaaattccggtgtccggacaggacgcggaaattcaaggcgtccgacgaattgtgaacggtacgcagacgatgaccgtttacaaaccgattcccgcgcttgccaaaaaaagcgcttaaatggctgttcaagcggcgaaaggcgaagcgattcaaaccgatacaaccgtcgaaaacggcaaagccaaagtaccggcgattttactttagccgtatgccgttacgaaaggcaatatcaattagactgtgatcaaagacggccatctgtccaaaaaagatattcatcaataaaacgaagtcagccatccgctacaggatggctgactttgttaaatttccactttcacatcggcgcttttcttaagcttttcgacctgctgtccgagtttttcctgtcttttttgctgtttgagcatatcttggatttgctgtttgacatcgtcaaacgcaggtgtgtttttctgtccgctgtctttttgctgtgcggcaaattgatcataatagtctttgatttctttgtctgtaacctgatctgtcggcagttctttgtcaatatatttctctgttttgatgctgtcggcaatgtcgcttttcagcgtgttcatgtttaagcctgcttttttgaccgcttcctcaaaatcttgctcgtttttatactgctttttgctttcgtccagctgtttttcaatttctttctcagatgctttgtagccttttttgtccgcttcctgcgtaattaatgcctgtccgatcaggctgtcgatcgcctgctttttgatttgctgcgcc

SEQ ID NO: 42 - protein, 366 aa, Bacillus licheniformis
MGGFNVVDICEKRAVGTCAVQSPHSCCRVLIQFCLKKRQPLRKSKADCRLRQIVRRFCHRYAEGRTLVQRSRSVRERSSKPRGGSQDACRSRKSRSSDSAGRALDQRRRRRACCCTGRCGCRGGDREKGAQRRCKSDFVLPADSKRGCLLLRFILSRKGRGTAGGSDCKKSEERKLRIYRRIVSLQQCGLIPERRHESARTVEAAGSSQARALRIYERLATRRSEKEHEKSIEQDERYRRRDRRQLRYGWRGDRGASGGGPGRENSGVRTGRGNSRRPTNCERYADDDRLQTDSRACQKKRLNGCSSGERRSDSNRYNRRKRQSQSTGDFTLAVCRYERQYQLDCDQRRPSVQKRYSSIKRSQPSA

SEQ ID NO: 43 - DNA, 1690 bp, Bacillus licheniformis
  CDS (480)..(1208)
cacgtctgacagccccagcgtatcgagtcccattaaatgggactgcaggccgatcaggttgcggtctctgcatgtgatatgaatcagcgacctcatatcgaggcgctgttttaagagcgccccgcaggcgacattgctgatcctcggtgtggcaagggagttgtccgccaatgtcagtgcatcgattccggctgattttagctcctctgcggcgtgcaaaaatttctcaaagtttaattgttttggaggatcgagctcgacgataatggaccgtttctgcttagccagatagtcaagagcaggctatgtcctttcgttttggacggcaagcgccgctttctttgggattttcactagtttttcggtgactggaggaagttctttgacggccctcggcatcgttctaccctgagtgtcttttatgcccgtctttaggcggccccgtcaacgaataatgcataaaaaaggaagattcatatgaaaatcgtaaacgttctgctcgctattttattgaccgcaatcatgttaagcggttgtttgtacccttaagaaagaaaggcgaaaaacagcgcaccgcatcagcaccagctcaaagaagtgcaggcggccgtttattaattcagggaggcgacgggagggcttctgccgattcagacaagggatatgggcgtgccaatctatcaaaaataccctatcgattttcacaggctgtccccccggtatatggcttagccgccgggcacatcctattaaaacggcggagagtacttgtacgttcttgtcgatgtggaaaaaaagccgacggtcaagctcatttatgtaaaaatgtcggaaatgatcagggagttaaagcttcgggtcgaaatgtatcaagatcagcacaagtatccgccgtatcaaaaagtcgtatccaagaacttattcatgctttaccattaaaagctcggactgaaagaggcgccttctgtcacgagtccgctttcgggcacctcgctgccgcttctcgtcgattaaaaaggcgacattcaagtggattaccggatggatttggccaagctgatgaagaagtcgaaaaaaacggtaaagccgggcgaggaagtccaagatttgatgtgggaagagacgcctttcgttccggcgttttcggtaaagtacacagtgaattacaaacaggaacctgtttttctcgaatagaatatcggtcaaaatgcaagtatcagtcatgaacctttctcctcggcatacaatgaggagaaaggttttttcatgtatgccgaaaaaatttccctaagctgtcatattgaaataggacaacgtcatacactatagtgtcctgtttttgattgatgaagaagtaaaaaattgaaaaggattggaagtccgggaggggatcacttggaaaaggtcgatattttcaaggatatcgctgaacgaacaggaggcgatatatacttaggtgtcgtaggagctgtacgtacaggaaaatctacgtttatcaaaaaatttatggagctagtggtgctcccgaatatcaacaatgaagcagaccgggcgcgcgcacaagatgagctcccccaaagtgccgctggcaaaaccattatgacaacctgaaccgaagtttgttccgaatcaggcaatgtcagttcatgtcagtgacggactcgatgtgaatataaggcttgtcgactgc

SEQ ID NO: 44 - protein, 243 aa, Bacillus licheniformis
ENRKRSARYFIDRNHVKRLFVPLRKKGEKQRTASAPAQRSAGGRLLIQGGDGRASADSDKGYGRANLSKIPYRFSQAVPPVYGLAAGHILLKRRRVLVRSCRCGKKADGQAHLCKNVGNDQGVKASGRNVSRSAQVSAVSKSRIQELIHALPLKARTERGAFCHESAFGHLAAASRRLKRRHSSGLPDGFGQADEEVEKNGKAGRGSPRFDVGRDAFRSGVFGKVHSELQTGTCFSRIEYRSK

SEQ ID NO: 45 - DNA, 1759 bp, Bacillus licheniformis
  CDS (476)..(1267)
tactgttccggacaaggctccgtaatggaaatgtcaggctttcggccggcaagagacgtataaaatgccaggaacgcattaaagtggcggatttcgtcctgtctgatttctaaaatttgctgttttgcctcagcatccggggccttttgtgcgattttttggtagcagacgaccgcactgtgctctccgtttaccgctttttctagatctttgatcagcctgttgttttgcctggcgggataggcgggatgatacggctgaacataccacatgtttttcacctcaatatcttatattttgccgtcctgtcattatatgtaagtcgaagcttgcatgtgcctactggaagggcgcatctcggacatgtggcaaaatggtgtggggagagcgcaatctattttaaaaaaatgaagtttgacgtaaaatggttgttagtgccgaatggtgacatacatatcaaaatggagtgagactattgaaaaaggcaatattgacggtcatagctgtattgacgtcggttgttttgttcgccggctgccaagcggaaaaagggggatcagccaaggggcagtctgaaaaagttcaaattacggtttccgcggctgcgagtctcaaggatgttttaacagaactttcctccgtctatgagaaagaccatccgaatgtctctataaagtttaattttggttcatcgggtgcattgcagcagcagatcgaacagggcgctccggctgatttgtttttttctgccgctgaagacaaatttaatagagtagttgatcaagggttaattgacaaaaaagactctgtcaagctggtcgaaaacagtctggtgctgatcgtgccgaaaggaaaaagtcagcatgtcaacagcttcaaggatttggcggatgacaaagtcgaaaaaattgcgatcggcaaacctgaatcagtgccagccggaaaatacgcaaaagaaacgttgacgaaccttgacgtatggtctaaagtgcaatctaaagtcgtctacagcaaagatgtaaggcaggtcctttcttatatcgaaacaggcaacgcggatgccggaatcgtttaccggacggacgccctttcatcagatcaggtcgagaccgtagagacggcgaaaagcgatctgcatacaccgattgtctatccgctcggaattgtgaaaaatacaaagcacagggaacagtctgaggaattttatcaattcctgcaaagcgaccaagccgtcaaggcgatggaaaagtacggatttaagaagggctgaccgccgttatgcttgaggagttcttatccccaattgaaatttccatccaagtatcagccgcagcgggcatcatcgccgttttgcttggaactgctgcagcgaggctcctggcgaacagaaactttaaaggcaagtccattatcgagacggtgatgatgctgccgctcgttctgccgccgaccgttgtcggattttttttaattgtgatcttcggaaggcagagcgtgatcggacgcttgattgaaaacgtgtttcaagcgccggttatttttacctggtgggcagctgtgatcgccgcggcggttgtcgcgttcccgttaatgtatcagtctgcaaaatccggatttctggctgtcgaccgcgacatcgaggatgcagcgagggttgacggagcaaacgaatggagggtgttcctctttgtcaccgttccccttgcatccaatggaatcatgacggggattgtgctcagctttgcgagggcgcttggcg

SEQ ID NO: 46 - protein, 264 aa, Bacillus licheniformis
LKKAILTVIAVLTSVVLFAGCQAEKGGSAKGQSEKVQITVSAAASLKDVLTELSSVYEKDHPNVSIKFNFGSSGALQQQIEQGAPADLFFSAAEDKFNRVVDQGLIDKKDSVKLVENSLVLIVPKGKSQHVNSFKDLADDKVEKIAIGKPESVPAGKYAKETLTNLDVWSKVQSKVVYSKDVRQVLSYIETGNADAGIVYRTDALSSDQVETVETAKSDLHTPIVYPLGIVKNTKHREQSEEFYQFLQSDQAVKAMEKYGFKKG

SEQ ID NO: 47 - DNA, 2449 bp, Bacillus licheniformis
  CDS (501)..(1946)
tctcctgatggatccggagtggctacaaaaagttcgagccggaaaagaggacgatattcaaacaaccctgtcaagacatgatcagcggaagctcgcaattccagatgccttttgggaaagtataccgatgtatattgatttcagcgattgacgattcccgcttatacagactatagattcatataaaaaaggtgtctttccgcttaaaatcggtgtcatttgcataaaaatgtataggaaaagaggaacttagaccagttgagtcccagagatgagtatattagaatgatggtaattcaatatcgtcgggattgttactgtctaagcaggcaagacctaaaatgtgtgaagggcgaaatctatcttttgcctatatgaacttgcacattttaggtcttttttctgttcttcaggacaatgccgcagttaggagggatgattgggaacgttcatgttgtcagaagcaatctattacatattgaaaaagggaggaaatattgatgaacatcaaaaacattgctaaaaaagcgtcagccttaaccgttgctgcggcactgctggccggaggtgcgccgcaaacctttgcaaaagaaacgcaggattacaagaaaagctacggattttctcatatcacaagacatgacatgctgaaaattcccgagcagcaaaagagcgaacaatttaaagttcctcaattcgatccgaaaacaatcaaaaacatcccttctgcaaaagggtataacaaaaatggagagctgatcgatttagacgtatgggacagctggccgctgcaaaatgccgacgggacggttgctacataccacggctacaatcttgttttcgcgctggcgggcgatccgaaagacgtcgatgacacatccatctatttgttctatcaaaagaaaggcgaaacttctatcgacagctggaaaaacgccggcagagtgtttaaagacagcgacaaatttgttccagacgatccgtacctcaaacatcaaacacaggaatggtcaggttctgccacgctgacaaaagacggaaaagtccgactgttttacacagctttttccggcacgcaatacggcaagcagacgctgacaacagctcaggtcaatttctctcagccggattcggacacgctcaaaattgacggtgtagaagatcataaatcggtctttgacggcgccgacggcacggtataccaaaacgttcagcaattcattgacgaaggaaactacagctccggcgacaaccatacgatgagagacccgcattatgtggaagaccgcggccataaatatctcgtatttgaagccaatacgggaacaaaaaccggctaccaaggagaagactccctattcaacagagcctactacgggggcagcaagaagttctttaaagaagaaagcagcaagctgctgcaaggtgcgaacaaaaagaacgcttcgctggctaacggcgctctcggaatcatcgaattaaataacgattatacactgaaaaaagtcatgaagcctttgatcgcctccaatacggtgacagatgaaatcgaacgggccaacctcttcaaaatgaatggaaaatggtatctgttcacagattcaagaggatcaaaaatgacaattgacggcatcggttcaaaagacatttatatgctcggctatgtatcaggttcattaaccggaccattcaagcctttaaacaaatccggacttgttttgcatatggaccaggattacaatgacatcacgtttacttattcacactttgccgtaccgcagaaaaaaggcgacgaagtcgtcattacaagctacatcacaaacagagggatttcgaacgagcatcacgccacgtttgcaccaagctttttgctgaagatcaaaggatcaaaaacatccgttgtcaaaaacagcatccttgaacagggacaactaacggtaaacaaataaaacgaacgaaggaaaatgccggtgaacatcggcattttctttcgtatgtcatcttagaataaagcggggaattttcttgaagaaggcagtatataagcggatcagcattttaactgtttgtcttggaatcttcatcatgatatttctttcagtccgggaaacagaaaaaaagggagaatctccggatacaccggaatatcgtgcagctttccatttgacaacccctgacaaatggaaaaacgaccctcaaaaacccgtctatttcaatggagaatatcattactactacctctataaccgagactatccggacggcaatggaacagagtggcgccacgcagtatcagatgatctcgtccactggcaggataaaggggttgccattccgaaatatacgaataaaaatggcgatccctggtccggttctgtcgttgtcgactcaaaaaacacagccggcttcggcaaagggacgatcgtggcggttatgacgcagccgtcgg

SEQ ID NO: 48 - protein, 482 aa, Bacillus licheniformis
MNIKNIAKKASALTVAAALLAGGAPQTFAKETQDYKKSYGFSHITRHDMLKIPEQQKSEQFKVPQFDPKTIKNIPSAKGYNKNGELIDLDVWDSWPLQNADGTVATYHGYNLVFALAGDPKDVDDTSIYLFYQKKGETSIDSWKNAGRVFKDSDKFVPDDPYLKHQTQEWSGSATLTKDGKVRLFYTAFSGTQYGKQTLTTAQVNFSQPDSDTLKIDGVEDHKSVFDGADGTVYQNVQQFIDEGNYSSGDNHTMRDPHYVEDRGHKYLVFEANTGTKTGYQGEDSLFNRAYYGGSKKFFKEESSKLLQGANKKNASLANGALGIIELNNDYTLKKVMKPLIASNTVTDEIERANLFKMNGKWYLFTDSRGSKMTIDGIGSKDIYMLGYVSGSLTGPFKPLNKSGLVLHMDQDYNDITFTYSHFAVPQKKGDEVVITSYITNRGISNEHHATFAPSFLLKIKGSKTSVVKNSILEQGQLTVNK

SEQ ID NO: 49 - DNA, 1669 bp, Bacillus licheniformis
  CDS (488)..(1168)
gcaagaggcggagagaaaaaacaagtcaagatcgcagaccagatcgaatataaaaacggcacattgatgacggcttttaaagatcacgagctcccaggagagaaaatcgaccagtatacagcgcaaaagctgcaaaaactgctcagaaaagttgtcacatctgaaaaggggacgggccggcgcttcagcgatcttccgtacgatgtagcgggaaaatcgggcacagcgcagacaggcaggacgacagatgacaaaaaaacgctctatcataaatggtttgccggttattttccggcggacaagccgaaatatgcgctcgtcgtcgtccatatggatacgccggatagcaaggctgcgacaaatgccgtattttatgatattgttaaaaaagtatatgaaattgaaaagaaccagacatagaagaatgcctcaggtgatgataaaataggaagcgaggcaagagggaaaaaggagtgcaatgaacttgagcgaaacaagggaatctcgttttgaaaatcgtgataagcgcaggaaagcgaatcttgtgcttaacattttaataggcatcgtattggtattaatcgttgtcgttgccagcagtctgatgatgaacagtccgaaggagcaggcgcagcaagatgtctcgaaaaacgattctgaacagacgacagaagcgcctgcttccgacaataagaaacaaacatctgatgaagatgtaaaagatgaggacaaaggaaaaagcgattctgccgataaagaagacagcgattccgactcagacaaggataaagaatctgcttcagacgaggacaagtcaacatcagatgatccgtttgaaggagccgaagtgacagaaggcggttcaagcgccaatgttgaaaaaacgatcatcaatcctgactgggagcctgtcggcacacaacagagcggacagcataccgcaacatatgattcctcttcacaagactggaaggaaatgcttgaagccatttcatatgcgacaggggtttctaaggataacatgacggtgatctggctcggaaacaacggcagcccgcaagatgcgaaaggaaccattcgggcgaaggacactggcgtcaaataccaggtagccattacttgggttgacggaaaaggctggaagccgacaaaagttgaacaattgaaataaagaaaaaagcggccggttgctaaaaccgggcgctttttttatgattcggctttaaaatgaacgactgcgctgtagtggatccgtccgtcaataaccgccgtatggtgggaaaccgaatggaccctcagcaaaatcgcctggttgttttcaatctgctgactgatctttttttcaagctcctctaagctcagtgcctcaaaaaactcaattttatctttgatcagatcgaggccgaagttcataaaccaatcctccattcgtttcaagtcattttttattaaagcagagaagcggccgggtgacaagggaaatataaccaagccttttttgtacccaaaacgaatgacttgtggtaggataagaactaatcaatcgaataaatcatactatacttataggaattgtaaaaatagatggagagtgacgacaaaatgggaagagagttcattcctttatttgagaactgggcaaattcttatgatgatacagtagttggcc

SEQ ID NO: 50 - protein, 227 aa, Bacillus licheniformis
SETRESRFENRDKRRKANLVLNILIGIVLVLIVVVASSLMMNSPKEQAQQDVSKNDSEQTTEAPASDNKKQTSDEDVKDEDKGKSDSADKEDSDSDSDKDKESASDEDKSTSDDPFEGAEVTEGGSSANVEKTIINPDWEPVGTQQSGQHTATYDSSSQDWKEMLEAISYATGVSKDNMTVIWLGNNGSPQDAKGTIRAKDTGVKYQVAITWVDGKGWKPTKVEQLK

SEQ ID NO: 51 - DNA, 1700 bp, Bacillus licheniformis
  CDS (437)..(1213)
tcccgggtttactgagatgtgctcgccgttttctgcaccggtgcgtacggctacagcatggccaacaactacaaccgcattccgcgcccggccgtcgtctttgtcgaggacggggaagcgcagctcgtcattcagagagagacgtatgaggatatcgtcaagctggatctgccgctgaaatcgaaagtcaaacaataaaaaaatggagattccctaagaggggggtctccaattttaattcaagcacgaaaaacacttcccggtgatcgggaggtgttttttgttaaaaagatcatgacatgcatagaacagcgaccgggctaattgtatataatatcgtgaatttaacaaaaaatttacaaaggagatgataaaggcgatgaccagggtgaaaaggatgagaattgctgatttgttggatttagaggcggagtagatgaaaccggccaaagtatccctactccaccgattgctccagtgcctgaagcaatgtgtcgattgttacacagtagatcgtgtgacagcaataaacatttttgtgaatattttattgatttcggctgtgatctcattcccatattctgctgcggcccatggcgcaacacagtccggcgatcaatattcagcttttgaagaattggagcggaatgaagatccagcttcttaccgaattacggagaagaacgcaagagtgccgatgctcatcatggccatccatggaggcggcatcgaacccggaacgagcgaaatcgccaatgaagtgtccaaaaactattccctgtacttgtttgaagggctgaaatcatcaggcaatacggaccttcacattacaagcacgcgttttgacgagccagcggcgctcgcaattactgcaagccaccagtatgtcatgtcgctccacggctattacagtgaagaccgcgatattaaagtaggcggcacagaccgcgctaaaatcagaatattggttgatgagctgaaccgctcggggtttgccgctgaaatgctggggacagatgacaagtatgccggaacccatccgaataacatcgccaacaagtcgctttccgggctgagcattcagcttgaaatgagcacgggtttccgcaaatctttattcgaccggtttacactaaaagacagggcggcgacgcaaaacgaaacgttttaccgatttacaaagctgctgacagattttattcatgaaaactatgaagaagacggaggggatttcccctctgcaaaaataaaacacccccttcaagtgtgaactgacccgttaaaatgagacttagaaaaaacacctatgctgcctgtcccctgtattccagtggggacaggtagtttaattttgcctgaattcgtacatgattatatcgatacatgtattgatttacaatttgtactactttagaattggatatagatgctctactttgagcgttaaatccttccgactttagcgaggagtgaaaggattcaatgacggcattatcatggcagtttccttttcgagacatgcttgtggtaatgcctttttctttggccaaattctgatatgcatgtgaagtatagacagatccctggtcgctatgaagaagaaccctactgggttacgtaattctaacagcttccctcaatgtgtctaatactaggttaaatatctggctcgtacctattttgtaagcactatttgtgtt

SEQ ID NO: 52 - protein, 259 aa, Bacillus licheniformis
MKPAKVSLLHRLLQCLKQCVDCYTVDRVTAINIFVNILLISAVISFPYSAAAHGATQSGDQYSAFEELERNEDPASYRITEKNARVPMLIMAIHGGGIEPGTSEIANEVSKNYSLYLFEGLKSSGNTDLHITSTRFDEPAALAITASHQYVMSLHGYYSEDRDIKVGGTDRAKIRILVDELNRSGFAAEMLGTDDKYAGTHPNNIANKSLSGLSIQLEMSTGFRKSLFDRFTLKDRAATQNETFYRFTKLLTDFIHENY

SEQ ID NO: 53 - DNA, 1519 bp, Bacillus licheniformis
  CDS (472)..(1026)
cggaatgatggagcctccatctttttcaaaaaacagaaagcgcaagtaaaccaagtcaaacgcgacaaatataatcaaaaacagctgaatcgaattccacaaagaatgagatctgaaaatttccagtgcaaagcggtgaatcgttaagaaaatcacaaatcccatttgagcaatcacgctaaagatcatgccaaccccgataaaccagaaaagaacagacagaatctccaatacctcgaaggaaagaaacagctccttatatcttccccactctatggcaaaaccgacaatacttgtagtcaaagctccgacacccaatacggaaaagaaaaatcggacgagattacggcttttcattgtagacttcccaacccctaaataaaccgctgtaacagcgatattttgttatgtataaatttttaaaagacattcatattaaaggtaagacgagttttcgaaaggagcttaagcatgttcaagaccgcaatgctatcgataagctgttttctgtttctatctgtaacagcttgtgctcccacggaccaagcagctgagatggactatgatcaaaccaaaaaaatggttgtcgatatattaaagacagatgacggaaaaaaagcgattcaagaaatattaaatgatgacaaattaaatgaaacacttgtaatggatgaaaaaactgtcaaagaaaccgttgaaaaaacaatgacctccaaaaaaggagctgaattttggaaaaaagtctttgaagatccaaaattcgctgaaggctttgccaaaacacttcaaaatgaacatgaaaaagtgctgaaaaaactgatgaaagatcctgagtaccaaaaaatgctgatgcaggtcatgcaggatcctgaaatggccaaaaaatacggtgaacttgtcagaagccaggaattccgaagccacctgcaggaagtcatatctgacactctgacaagccctctttacagaaagcagtttgaagaggaactgaaaaaagctgctgctgaaagcatgaaagaagaaatgaaaggcggcgaagaaaaacaaagctgagccgcttttcattccctaaaagcttcttctgcggaggaagctttttttgctctttaagcttttgcgccaatgctttcgtcgatttttttggcgatatccaaataaatggcgccggtcgggtggctttcatcataaacggacggcgcaaattcgctgtcatcccaatccggctgcttcagcggaattttgcccagaattggaacgcctagttcctctgcgagcttttcgcctccgcctttgccgaatacatattctttctcgcctgttttgacgctttcgtaataagccatattttcaacgatccccacgatttcatgatcggtcttcaaggccatcgcgcccgctcttgcagcgacaaacgcggcagtagggtgcggcgtcgacacgatcacctctttgcagcttggaagcattgagtgaacatcaagcgctacatcgcctgttcccggcggcaggtctaagataa

SEQ ID NO: 54 - protein, 185 aa, Bacillus licheniformis
MFKTAMLSISCFLFLSVTACAPTDQAAEMDYDQTKKMVVDILKTDDGKKAIQEILNDDKLNETLVMDEKTVKETVEKTMTSKKGAEFWKKVFEDPKFAEGFAKTLQNEHEKVLKKLMKDPEYQKMLMQVMQDPEMAKKYGELVRSQEFRSHLQEVISDTLTSPLYRKQFEEELKKAAAESMKEEM

SEQ ID NO: 55 - DNA, 2404 bp, Bacillus licheniformis
  CDS (501)..(1901)
aaacagcagcgccctgacgacatcctcgtgtccttcttttttcagcttgcactcctttttcatctccatcagcatatgttcgactgcggcctgttcacgcagggaaaatgcgatgaagttttgattttccggaaacggaagaagccgataatggctgcacttcagcaatggttctatgaaatcgtgcgagaaattaatcaggatgcgttcgaactcttgaacttccgtgcttgacgttcggtggaggtcgtggggattgatgatgatcatcgtgcctttttccgcggtatagacgctttggttaataaaatacgtgcgttctccgctcagcagataatacagttcatagccttcatgaacatgcggcgcgttcatctcggtaaatccttttctctgcatatattgaatcgaaaaagaatgctcggctatgaaatatttaggatggagcatgtcgggcattcctccttgagagcgttttcttaacaaacgggagggatcgtatgaaaaagttatgttgcctgatcttggtcttggttttttccgcgggctgtactcagcaaaaggcatcaacggaagaggacggggcgcttgaaatcaattggctcgtaccgctccacacaccgcagcctccgaaagagaaggcgcttgacatcattgaagacaaaacgaatacaaagctgaagctcatctgggttccggattcaacaaaagaagagcggatcaatacaacccttgcaagcggaaacatgcctaaagtaatgacattgcctgatcttgaagattcagcggttgtcagcgcgctgcgctcgggaatgttctgggaaatcggaccgtatttcaaagactatccgaatttaagaaaacttgataaaactatattgaaaaatatttcggttgatggcaaagtttacgggatttatagagaaaggccgatggccaggcagggagtcgtgattcggaaagactggctcgacaatctcggattggaaatgccggaaaccgttgatgacctttataaaatagcgaaagcatttacagaacaggaccccgatcaaaacggaaaagacgacacgttcggtctcgccgaccgcaatgatctcaccttcggagcgtttaaaaccctggcttcgtactttggcgcgccgaacgaatggggaacggacgaagacggaaatctcttcccctattttaagcatgaggcctataaagacgcaatggcatacatgaaaaagctttatgaagaaggcctgatgaacagggactttgcggtgacaagcaaaacgcagcagcaggatttagtgattcaggggaaagcgggaatctatatcggcgcgatgagcgatgccatgaacttgcgtgatcagggactcgctttgaaccccggctttcagcttgatatcgcaaaccggatcaagggccccgacggcaaggagcgcacatgggcgctcggcgggcatggcgggatgttcgccatttcgaaatcaagcgtcaagactgaaaaagaggtcagaaaaatcctcgcattttttgacagaatcgctgaagaagacctcaacaatttgatgttgtatggaatagaaggcgtacactatgaaaagaaaggggggagcggctattttcgaaagcaggaaaactaccatctgtgggaagcggaaattcagccgttaaaccagctgattggcgtcaataaacaagctttaaaaagcgctgaagatccgctccgcgccaaaaatgaaaagcttgaggaggacaaccgggcaatcgcagtccagaatccggccgaaccgctgtattctgccgcacagatggacaggggaacagaattgaagaaaatcattgatgacgccacatttcaatttattctcggggaaatcaatgaaaaagctttgaccaggcagtcctgaaatgggagaagcatggcggcggaaagatcatgaaagaactgaatgaagatctgaaaaaagcaaactaaacagaaaaccctttccatttttttgaaaaggaaagggtttttcatcgtattcgctccaagttcattttctttaaattctgcaaaataaacaatataattccatcataggacgaaaaggaggaagcgatatgcagactgccgttatatatgcacacccaaatccaaacagtttcaacggagccattttaaatcaagtcataaaggcgcttgaggacggtaagcatttttatgacgtcattgatttgtatagagaccggtttgatcccgttctattatttgatgaaaagaaaaggcgctcagatatgaatcgcgatccggaaactgccgaatatcgaagaattgtcaaaaacgccgaccatctgattttcatttatccgctttggtggggcggaatgccagcgatcatgaaaggctttattgaccgcgtttttg

SEQ ID NO: 56 - protein, 467 aa, Bacillus licheniformis
MKKLCCLILVLVFSAGCTQQKASTEEDGALEINWLVPLHTPQPPKEKALDIIEDKTNTKLKLIWVPDSTKEERINTTLASGNMPKVMTLPDLEDSAVVSALRSGMFWEIGPYFKDYPNLRKLDKTILKNISVDGKVYGIYRERPMARQGVVIRKDWLDNLGLEMPETVDDLYKIAKAFTEQDPDQNGKDDTFGLADRNDLTFGAFKTLASYFGAPNEWGTDEDGNLFPYFKHEAYKDAMAYMKKLYEEGLMNRDFAVTSKTQQQDLVIQGKAGIYIGAMSDAMNLRDQGLALNPGFQLDIANRIKGPDGKERTWALGGHGGMFAISKSSVKTEKEVRKILAFFDRIAEEDLNNLMLYGIEGVHYEKKGGSGYFRKQENYHLWEAEIQPLNQLIGVNKQALKSAEDPLRAKNEKLEEDNRAIAVQNPAEPLYSAAQMDRGTELKKIIDDATFQFILGEINEKALTRQS

SEQ ID NO: 57 - DNA, 1589 bp, Bacillus licheniformis
  CDS (501)..(1388)
tcccaaaagaaaacggttcggagagtcgttacgcccatccttgacttaatgcagacaatgccggcattcgtttatttacttccggccatcttctttttcaatatcggggttgtgccgggtgttgtcgcttccgttatctttgcgatgcctccgacaatccggatgacgatcttagggatccagcaggtgcctgaagatctgattgaagctacagaagcatttggttcaacgacaagccagcggctctttaaagtgcagctgccgctcgcgacgaaaaccattctggccggtatcaatcaaagcatcatgcttgctttgtcaatggtcgttattgcatcaatggtaggcgcgcccggactcggagaagaagtttaccgggctgtgacccagctgcaaacgggtaccggtgtagaaaccggacttgcgattgttattattgcgatcgtacttgaccgggttacacaaaatataaaattgaaaaagagcagggggaatgcataatgtggaaaaagatagcgggaatcggcactgcagcggtactcacattgggtctggctgcctgcggaagcagcaataataatgaaaatgcgtcagtaggcgatcaagtcaattataaaattaccggcattgatcctggagcgggcattatgaatgcgacggaccaggcgctcaaggactacgatctcagcaagtggactgtaacgtcaggatcaagctcagcaatgacagccgcattgaaaaaagcttatgacaaaaaagatccgatcatcattacgggctggacgccgcattggatgtttgcaaaatacgatctgaaatatttaaaagatcctaaaggttcctacggcgatgccgaagaaatccatactgttacgcgcaaaggattcaaggacgaccatccgggcgcaaacaagctgctcagccaattcagctggacagaggatgatatgggagaagtcatgcttgccgttcaggaaggcaaaaaaccggaagaagctgcagcagacttcgtgaaaaaacatcaagatctagttaagaaatggacaaagggcgtcgataagcggacggtgaaaaaattaagctcggctatgtggcatgggacagcgaaaatgcgagcacgaatgtcatcgcaaagttctttaagactagggatacagcgtacgctcagcccaagtagaagcaggcccgatgtgagctggcatgcaaaatggaagcgtcgatgcttcacttgctgcatggctgccgcaacgcaatcaaacatatgcttaaaaatacaaaggcaaatacgaagatatcggtactcgcatgacaggcgtaaaaattggccttgtcgttccgacatatatgaaagatgtcaattcaatcgaagacttgaaaaaataacgaacaaagccggcgaacccatctcgccggcttatttttgccggaaagggataaccgctcatcacccgaatcctcccggatgcaaaaaaaacatcctaaaacgttaaaccgctttaggatgctggactcaactgaagccttccatagcagagacagcttcggttattaatttttcgttttaatttttccgccccattttttgaacc

SEQ ID NO: 58 - protein, 296 aa, Bacillus licheniformis
MWKKIAGIGTAAVLTLGLAACGSSNNNENASVGDQVNYKITGIDPGAGIMNATDQALKDYDLSKWTVTSGSSSAMTAALKKAYDKKDPIIITGWTPHWMFAKYDLKYLKDPKGSYGDAEEIHTVTRKGFKDDHPGANKLLSQFSWTEDDMGEVMLAVQEGKKPEEAAADFVKKHQDLVKKWTKGVDKRTVKKLSSAMWHGTAKMRARMSSQSSLRLGIQRTLSPSRSRPDVSWHAKWKRRCFTCCMAAATQSNICLKIQRQIRRYRYSHDRRKNWPCRSDIYERCQFNRRLEKITN

SEQ ID NO: 59 - DNA, 1682 bp, Bacillus licheniformis
  CDS (501)..(1181)
acattagataagcaaaaacttccaaaagaaaagctgctttttgcaggagacggcatcaacgatacgccggtcttggcgagagcggatatcggggttgccatgggaggcctcggttctgatgcggcagtcgaagcggctgatattgtgatcatgacggatcagccttcaaaaattgcggaagccatcagcattgccaagcggacgaggacgattgtctggcagaatattatttttgcactcggcgttaaaggagtttttctcatcctgggtgcttttggcatcgcgacgatgtgggaagccgtcttttcagacgtcggtgttacccttctggctgttttaaatgcgatgagggtattaaaagtgaaagaaatgtaacttttttaccacctaatgaactggaaattccttttttagcatcttcacgaatgcggcttgtcttgttaaaatgaaagaggttatcaaactggcatactaaaaaataagaataatgaggtgtctaagtgaagaagaaacagcagtcaccgatgaaatttgcagtgattatgacagtcgtggtcgtttttctgatcggcgcacttgtcgtaatcaacaatcaaacccaaaatgcttcgcaaacctttgatgacaagccttcaactgaaggacagccgcttctaggcaacaaagatgcggctgtaacgatcacggaattcggagattacaaatgtcccagctgcaaacagtggactgagaccgtctttccggatttgaaaaaggattacatcgataaagatcaagttaatttttcatatattaacttcgtcaatgaacagcacggcagaggctctgaattgagcgccctcgcttccgagcaggtatggaaggaagatccggattcattctggaagttccatgaggcgttgtacaaggcgcagcctgacaatgacacgatggaaaacgagtgggcgacgccggcaaaattggcggacatcacggaagccaatacgaaaatcaaacgcgataagcttgtcagcagcttaaatgacaaaacgttcgctgagcaattaaaaacggacaattcgctcatcaacaaatacggtgtagactcgacgccgacgatctttgtcaacggcgtaaaaatcgacaaaccgtttgattatgacaaaatcaaagaaacgatcgagaaagagctgaaaggccagtctgatgaaaaataaactgctttttctgtacggcgcctggatcgtctcattaacggcgacgctaggcagcttgtacttcagcgaaatccgcaaatttattccttgcgaactgtgctggtatcagcggattatgatgtatccgctcgtgctgattctcggaattgcgacatttcagggcgatgcccgcgtgaaaaaatacgtgctgccgatggcggtgatcggcgcaggcatttccctgatgcactacatggaacaaaaaattcccggattcaacggcattaaaccgtgtgtcacaggagtgccttgctcagggcagtatatcaattggttcggtttcatcacgattccgtttctcgcccttattgcatttattttgattatcatttttatgtgctttctcaaggggaaagacgagtaaaaagagcattgtctgacaatgctctttttttatttcttatacatgttcaatagaaaggatgttataatatttggaaattatca

SEQ ID NO: 60 - protein, 227 aa, Bacillus licheniformis
VKKKQQSPMKFAVIMTVVVVFLIGALVVINNQTQNASQTFDDKPSTEGQPLLGNKDAAVTITEFGDYKCPSCKQWTETVFPDLKKDYIDKDQVNFSYINFVNEQHGRGSELSALASEQVWKEDPDSFWKFHEALYKAQPDNDTMENEWATPAKLADITEANTKIKRDKLVSSLNDKTFAEQLKTDNSLINKYGVDSTPTIFVNGVKIDKPFDYDKIKETIEKELKGQ

SEQ ID NO: 61 - DNA, 2308 bp, Bacillus licheniformis
  CDS (501)..(1805)
ttttgttttcgacgacatagttgcgtgaggacggcacgagtgtagtgaaagaaagcaaaaaaaacaaaagcacacgaggccacgcgaggaacgacccaggcagcgggcagggaggcggacggcagcaagacggcgtgcaagcaaaaagacgaaagtgcatcagtcaaagaaaggaaacaagcaggaagatagtgaacggggcgtaccaggatcaactcacacccacccccagatcccggcagtccgttaacccatgaccagtatgtatataccccggcacaagaccattcattttcaccccatagccgattttttcatttcctcccatttcaccaccacattcagagtccgttctctcattcgttcataacaatcgacagggcatttgtcataacatttcacaatggtgtcccaaacaatagcagcacaatatgttgttttctgtatttttatagcatatattagtttttgtgaaaaaattttgatggtaggtgcaattgatgaaaaggttttttagtgtaataattttaggcgccctgttgctgctcgggacatctgcgccaatcgaagcggcagactacggacgcgacgtcctcggctcaaaagacggctggggcgcttatggaaaaggaacgaccggaggcgctgacgcttcttctgatcaggtatatacggtcaaaaaccgcaagcagcttgttgaggcattagggggagacaataaaaagaacagcgaaaatgatacgccgaagatcatctatgtgaagggaacaatcaatcttagtgttgatgatgacaacaatcctttaggctatgaagattataaagaccccgaatattcgatcgaagcgtatctcaaagcttatgatccgaagaaatgggggaaaaaggagccgacaggaaagcttgaagaggcaaggctccgctcgaaagataatcaaaaggaacgggtcttgatcagagtcggttcgaacacaacgattatcgggctcggagatgatgcgaaaatcgtcggcggaggcctttatgtcaaaaacgcggaaaacgtcattatccgcaatatcgaattcgaaaacgcgtacgatttcttccctggctgggatccgacggatgggagcagcggtaactggaattcagaatatgacaacctgctgatcgaaatgtccaaaaatatttggatcgaccactgctcattcaatgacggagatcagcctgatgagctgactgaaacgcatttcgggcgcgaattccagcatcacgacggactgcttgatatcaaaaagcagtcggatttcattacggtgtcatacagcatattttcaggacattctaaaaacacgattatcggatcaagcgacagctacaaagcagacaacgggcatttaagggtgacattccaccacaatctctacgaaaatataaaagagcgggcaccgcgcgtccgctacggaaaagtgcacatttacaacaactattttaaaagcacgaaagacagctacaattattcatggggcgtaggctattcttcaaaaatttatgctgaggacaactactttgacctgccggaaggaacgaagcctcaaaaactgatgaaggtctttaaaggtgacgctttatatgaaaaagatacgatcgtaaacaaccaaaaaagcgtcgcaaaaattgatgttgtcagcacatacaacaaagcaaacaatgcgtctattaaaaaatcggccggctggaagccgacgctgtttgaaaaaatcgacgacgcagaagatgtgccggcaatcgttgaagcgcacgcaggcgcaggaaaactgaagtaatcaagcaaagcggacatgcagatgatgtccgcttttttgttcaggtatcttgcaatgcaaaatagtgtatgttatcattcgtgtatcttgtattgcaagatacataaaagaggtggcttatgagttcaacgcaaatgctgaaagggattttagaaggatgtctgcttgccgttatatcagaaggggagatatacggctatgaaatgacaaaggtgcttgcgggatacggtttttcggatatcagcgaaggaagcatctatccgattctcctccgcatgcaaaaggaaaaatgggtggagaccgaactaaaacggtcggcgagcggcccgaagagaaaatattacagacttacaccccttggagaagcggagcttcaatcgttcatcgaccgttggaaagcattatccgggaacgtcaatgcactgctcgaaaaaaaactgaaggagaagtgaaactgtgctatcaaaggacatgcaaaacgtattggacgagatgagaat

SEQ ID NO: 62 - protein, 435 aa, Bacillus licheniformis
MKRFFSVIILGALLLLGTSAPIEAADYGRDVLGSKDGWGAYGKGTTGGADASSDQVYTVKNRKQLVEALGGDNKKNSENDTPKIIYVKGTINLSVDDDNNPLGYEDYKDPEYSIEAYLKAYDPKKWGKKEPTGKLEEARLRSKDNQKERVLIRVGSNTTIIGLGDDAKIVGGGLYVKNAENVIIRNIEFENAYDFFPGWDPTDGSSGNWNSEYDNLLIEMSKNIWIDHCSFNDGDQPDELTETHFGREFQHHDGLLDIKKQSDFITVSYSIFSGHSKNTIIGSSDSYKADNGHLRVTFHHNLYENIKERAPRVRYGKVHIYNNYFKSTKDSYNYSWGVGYSSKIYAEDNYFDLPEGTKPQKLMKVFKGDALYEKDTIVNNQKSVAKIDVVSTYNKANNASIKKSAGWKPTLFEKIDDAEDVPAIVEAHAGAGKLK

SEQ ID NO: 63 - DNA, 1856 bp, Bacillus licheniformis
  CDS (465)..(1358)
tgtaaacgggaggaggtattctggaggacatgataggtaagccggggtgatagtcacagtaaatagggagattataacatagagaagatgcagatcagtgatggggagggcgaagataacacacgaggaagacgcggaataaggaggaacatagtgacgcagggtgaacggtagggagggtggcaaatagtagtatgatatttgaaagacgggtcccgtacgaaatcggtgaaaaacaaaggcggaaaaacgaagtacaagccgtatgtttcaaaagcgctttatgatgccaataagaagctggaccgcgataaagacaaaattgcctgtgagcgctgatatatccaaaaaaagatctctgccaagggatctttttttgtttatcaggaaatttatgaaaattaaagactgctgaaacataatcttaacagtgcgaacctatactttggcaagagaagagcaaaaggggagtggatgatgtgtcagctttattcaaaaaattgatgttatcttcattgatcggggtttccatcgggtcagcgctgtttgcaccgaatgcgggtgcacaagagccggcggtgaagcctaaaaaagtggatgtcattgcacacagaggcgcttcgggatatgcgccggaaaacacgatggctgcttttgataaagcgcttcagatgaaagcagattatatcgagctggatgttcaaatgtccaaagacggggagcttgtcatcattcacgatacgaccgtaaaccgtacgacagatattgactcagtgctgccggttgccgtaaaggatttgacgcttgccgagctgcgcaagcttgatgccggcagcttcttcggtccgcagttcgcaggagagcgcattccgacatttgaagaagtgcttgaccggtataaagggaaggtcggaatgctgatcgaattgaaagagcctgcacgctatccgggaatcgaaggaaaagtgtcagcagcattgaaagagcggagaatggataagcctaaaaacggaaaaatcattgtacaatcgtttgattttaactctgtctataaaattcatcagctgcttccatcgatgccgacaggtgtcttgacgtcaaaagcggcggacttaacagatgcaaagcttaaggaattttccggctatgccaaatacgtgaacgccaacttgaaaaatgtggccgctgatcctacgcttgtgccgagaattcatgcgctcggcatgaagatacgcccttggaccgtccgctcccgcgatgaagtgcctccgctatcaaggcccgcgtggaacgggattgtgacaaaactttcccgactattgttccaaaaaagtacgggagccccaataaaaaaccctgaagtttgctttgaagggctttttaatttaaaaataaaaatggggcttaaaacaaaaaaggttaacgttaacgggtttatcgttccccccgattttttttgggacacctgggaaaaacgggtataaacctttgggggccctttttgggggccttaaaaattttgaaatttgccccgggggccctccttgtggccggaggggggaaaattttttttttattccggggtttttataggggggcaaaattttaaacccccttttctctcaaaaaaaaaaacccgggggtttttttttttgggtactgccgccgatgaccttacatatgggctgaactgcaaaaacaatggaagaggaaaacctgcaggcccgcatcgtctcattcagcgttgatcccgaaaatgatacgcctgaaaaattgaagaaatttgcggccaactacccgctcagttttcaaaattgggactttttaaccggatactcgcaggaagaaatcgaaaa

SEQ ID NO: 64 - protein, 298 aa, Bacillus licheniformis
RGVDDVSALFKKLMLSSLIGVSIGSALFAPNAGAQEPAVKPKKVDVIAHRGASGYAPENTMAAFDKALQMKADYIELDVQMSKDGELVIIHDTTVNRTTDIDSVLPVAVKDLTLAELRKLDAGSFFGPQFAGERIPTFEEVLDRYKGKVGMLIELKEPARYPGIEGKVSAALKERRMDKPKNGKIIVQSFDFNSVYKIHQLLPSMPTGVLTSKAADLTDAKLKEFSGYAKYVNANLKNVAADPTLVPRIHALGMKIRPWTVRSRDEVPPLSRPAWNGIVTKLSRLLFQKSTGAPIKNP

SEQ ID NO: 65 - DNA, 1768 bp, Bacillus licheniformis
  CDS (501)..(1265)
gcgtttcgcgatatcaatctcgactacatcaaagtcccggtggatgcctcagaaaagatgaacgatcaattgatggacaaattggagccatatccatatgatcagctgaaagattttaaaacggcctatttggcaggctacatcgctgaaaaatataattacgatgatgaagagctttttccgcgggcgaaaagcaaaatcagcggctacatcgagtcatatatcgattccaccctgtccgggtacagctcagtcgatgtgaaaacgaaacacgtcgatacacaaaaagtgaaaagcttgtatgtgcttttgcccgtctggatggtcaattacaactacaaacaaaaggattacatctttgccatgaacggacaaacgggaaaagtcgtcggcaagccgccgatcagctcatttaaagaaaaaatgtggttcagcgggctggccgtctccatatttgcactctggaaaatcattgctgctgtaatgggaggcggggcgtgatgagaagtttattgagaagcgcgatgatcttatgtatgattttccttgtcttcatccctatagcctccggtgcggcagcctctgaacagaagcggtttgtttatgatgaagccgggcttctgaccaaacaggaaatcgagaagctggaaacgctggcagccaaattgggcgccgaacgggagaccgactttatcattgtgacgaccaatgatacaaacggccgcgatgtaaagaaatatgcggaggacttctatgacgaaaaagcgcccggctaccagaagaagcacggaaatgcagccgtattaacggtagatatggagcatagagaagtctatcttgccggctttaaaaaggctgaagaatatttgaatgacgccaggctggacaaaattagagaaaaaatcacgccggatatatccgacaagcattatgaggccgcattcgaaatgtttatgaaggcggcgcatgatgatatggagaagaaaccgtgggcggacagcatcttttttaagacgtggtttcaattgcttgtttcggcagtcatcgcgggaattgccgtcgccattatgaaatacaattcaggcggcaaagtgacagtaagtgcaagcacttatatgaacggtgatacgtccggagtgatcagaaataatgacgaatacatcagaacgaccgtcacaaaacagagaaaaccgtccaataataaaagctcaggcggcggaacgacgagcggaggccattcgcacagcggcagccggggaagcttttagaaagggaaaggaagagcttaaatggtgttttttagaaatcaatttgcaaatgtagtagagtgggatgaatttcgcgatgatatgattttctataaatggaacaaccgcgaaatcaaaaaggggagccggctgatcattcgccccggtcaggatgccgtctttttaaacaacggaaaaattgaaggcattttccaggatgagggcgactatgatattgaatccgaaattattccttttttatccactttaaaaggttttaaatttggctttaacagcgggatgcgcgccgaagtcctgtttgtcaacacgaaggaatttaccgtcaagtgggggacgaagaatgccatcaatatcccggctgcaggacttccgggcggcatgccgatcagggcgaacggaagatttaactttaaggtgaatgattatgtcgcattaatcgataaaattgccggtgtgaaagatcagtatgttgtggaagatatcaaaatacggatcacatc

SEQ ID NO: 66 - protein, 255 aa, Bacillus licheniformis
MRSLLRSAMILCMIFLVFIPIASGAAASEQKRFVYDEAGLLTKQEIEKLETLAAKLGAERETDFIIVTTNDTNGRDVKKYAEDFYDEKAPGYQKKHGNAAVLTVDMEHREVYLAGFKKAEEYLNDARLDKIREKITPDISDKHYEAAFEMFMKAAHDDMEKKPWADSIFFKTWFQLLVSAVIAGIAVAIMKYNSGGKVTVSASTYMNGDTSGVIRNNDEYIRTTVTKQRKPSNNKSSGGGTTSGGHSHSGSRGSF

SEQ ID NO: 67 - DNA, 2206 bp, Bacillus licheniformis
  CDS (501)..(1703)
tctcccggagttcttcccaataggatacctcttcgtactccaaatgctcgatcggcgcaccggtaataatcatgccgtcgaattttcggtccctgattgaagaaaaagttgtataaaactgttccaaatgctgccttggtgtatgttttggcgtgtgtgtagacggtattaaaaaagtgaaatatacctgtaaaggagaattcccgagcatcctgagcagctgtgtctcggtcttgattttctgcggcatcagattaagaatcacaatatttaaaggtctgatgtcctgatgaaaagcccgtttttcatccatgacaaaaatattttcactttcaagaatctgctttgctggcaaattgataggtatgttgataggcaacacgccacctccggttttctccgctgatttttcttcatatcggagcgacagtcgtgcgttaagctggcagctgacatcgtatgaattaaaaggaatcttgaacaactgccggccgaaggtgatgttttatgacttggaatttgccgatatactaacgccgctccgcgaacagcttcagttctgcctgatgattgaagcgggtgcgggaatgaacacgactgaacagtttgagagcttatttaaaaacaggccgctgaaggtggaagctgagcaggtgacagagcatgatttggctttaatgctgttcacctcgggcacgacgggaaacccgaaaggctgcatggtcaaccacggcagtctggccgcatacttgacagaggtgaacgtgaaatcgaagcagctgaaaggcacgcgctttttagcgagccacccgctctatcatatgagctcgctcaaccatgtttttcaggcggcttttgaaggaattgccctttatttcttatgggatcccgaaccgtttgaaatcctgcaggagatcgagaagaaacgcattcatatgatgatggcgtttccttccgtctacacctacatgctggaggaaatgaaaagacatccattcgacctgtcatctgtgaaaatgcttgtttccggcggcaccaaggtgccggcgcggctgattaaggagtacaatgaccatggaatcatgatggtgcaggggtacggcagcacagaagcatggacggtcagcgtatggcggcctgacatgggctgggataaagtcacttcagccggcaagccgattccgcaagtcagcataaaaatcgaagaccctgatacacatgaagagctgccgacgggagaagtcggagaagtcgtcgtcaaaagcccgtatgtttttgaagggtattaccaaaatccttccgccacgcaaaaggtgctgaaagacggctggttctatatgggggactccggcaaactcgatgaagacggatttttatatattaccggccggtataaagacgtcattgtctacggaggcgacaacatttatccggaccaagtggaagaaatcatcgatcaagtgcccggagtagttgaatctgccgtcatcggcgtcccggatgaaatgtacggcgaggttccgagggcgtatgtggtgaaaaatgaaagcgccggcctcaagaaggaggacattatcgcgtattgcaaagagcgcctgtccgactataaaattcctgaaatcgtctttatcgacagccttccgaaaaacaggctcggcaaaatcgtcaaaaaagatctgcgtgaactggcagtcaaagggcagtgagcgcaatgattgaccgaaagcttatccagcattggataagctttttgtgctgattccttgcatcagctgccgttttttgtaacgttttccagtgctaaacccactacaacattaggaggtgttgacaattgaaatcgaaatggagtgcaatggtggttattgccggtcttttattgctggccggatgcggtgcactgaaggaggctgatcccccgcgcggcagatcagcgcaaaaaacggaagcctcgttttctgaagctgaacagcgatttgcgctcgccttgtttcaagacatgataaaagaagaagggagccggaaaaacatcttcctctcgccttacagtattcagcaggcacttttgatgacggcaaacggtgccgcgggagacagcagaaaggacctgatcagcactttacatctcagccaggcggatatggcatcgatcaacgggatatcaaaatctgttaatcgttctcttgaaacgctgcctcacggtgaa

SEQ ID NO: 68 - protein, 401 aa, Bacillus licheniformis
MFYDLEFADILTPLREQLQFCLMIEAGAGMNTTEQFESLFKNRPLKVEAEQVTEHDLALMLFTSGTTGNPKGCMVNHGSLAAYLTEVNVKSKQLKGTRFLASHPLYHMSSLNHVFQAAFEGIALYFLWDPEPFEILQEIEKKRIHMMMAFPSVYTYMLEEMKRHPFDLSSVKMLVSGGTKVPARLIKEYNDHGIMMVQGYGSTEAWTVSVWRPDMGWDKVTSAGKPIPQVSIKIEDPDTHEELPTGEVGEVVVKSPYVFEGYYQNPSATQKVLKDGWFYMGDSGKLDEDGFLYITGRYKDVIVYGGDNIYPDQVEEIIDQVPGVVESAVIGVPDEMYGEVPRAYVVKNESAGLKKEDIIAYCKERLSDYKIPEIVFIDSLPKNRLGKIVKKDLRELAVKGQ

SEQ ID NO: 69 - DNA, 1547 bp, Bacillus licheniformis
  CDS (501)..(1046)
gccgtatatttttcaacgggcagacagtcgatgcagcctaaaaaatcttgcagcagattgtctggcgcgttttcattcatagacaatttttgatattcataaattaattgatccagctcctggctccgcctgatcgtttcatcccctgtatatccatagatttcagcggcttcaaccatcatttgccgcttcttgctgatggaaacgagcaatgcttctttttcaatatacctttgcacccgctcccgggaggtcccaaaaaaatttttttgcaaaaaaaaatttttccccataaggctctagtgttatgagaaaaaaatccgggaacggaatcaaggaccataaaaattttttctggccaacccaaaaccccggtgcgtttaagtcgtcataaataagaaaccagcggaggaaaaatttttctcgcaaccctcttgtaatctatctgacgttattgtaacatttgtaatataagagatatatttaaggagagaggaccattgaaaaagttaatcgtttgtttattagctgttttactgatcttgcctgccggagcgtccctcgcagcgaaaaatcaaacatcagggaatttaacaaataagcaagtcatgcaattaaccttgcaggcacgggagcacttttggaatacgatgagcggccacaatccaaaagcgaaaaactcaacttgcccatccaaaacatttgaataccgcggtcttccatatacgtatatgtgcagtgaattcagcacaaaagcaaaattaacagactacttgacgccggttttcacaaaagacgccattaaaaaaggcttggaaaaatacaacatcatttcttataaaggaaaaatggccgtgcctgtcggcgatggggacaacctcttaggatgggacaaggcaaaaatcaaactgatctctcaaaaaaacaatacccgcacttatgaattttccgtaccggcattggatggatcggtgactgcgaaaagaaagatcacgtttgtgaaagaaaacaacaaatggaaaatcaatcagctcgatgctgccatctaaacgaaaaagctaatgtctaaaaacggacattagcttttttccgtcaaacggtcagttcaacgatgttgccgtcaggatccagaatgactctttcataatacccgtctcccgtgacgcgcggctttccggcaacctggtatccttccttttcaaagcggctcgtcatctcgtcaacctcttgccgcgaccctaaggaaaacgccatatgtgcatagccggaagcgttctcctctccttttgcaaggtcggggcgtctcatcagctcaagccgtgttcccgattcaaactggatgaaatatgattcgaaatgctttttcggattgacatatttttcattcgtctttccgtgaaaaaaacgggtatagaaatctttcatttcctctaaattgttcgtccatatggcgatgtgttcgattttcataaatctccctcccatttcatattaccatatagatcctctgcctttttttacacttttttaaattgataagtattcat

SEQ ID NO: 70 - protein, 182 aa, Bacillus licheniformis
LKKLIVCLLAVLLILPAGASLAAKNQTSGNLTNKQVMQLTLQAREHFWNTMSGHNPKAKNSTCPSKTFEYRGLPYTYMCSEFSTKAKLTDYLTPVFTKDAIKKGLEKYNIISYKGKMAVPVGDGDNLLGWDKAKIKLISQKNNTRTYEFSVPALDGSVTAKRKITFVKENNKWKINQLDAAI

SEQ ID NO: 71 - DNA, 1621 bp, Bacillus licheniformis
  CDS (271)..(1122)
gcttgatggcagtgcacgggtttggctattctgcgcttccggcaatgaacgatgcctggagtgctgtattcagccgctcgtttgccatattcacagtttttgtattggctggcggattgctatatttattgacttgcaaacgcaaaaaatcttaggatattcgagtggttgggcgggaaagcccagccgttttttatgctgactcgattttctgaaacataatgaaaagaaaatcgtatttgatgtaaagcttcttgagaggatgaaaatgatgaaaagaagcatcggcaccttttaaatttacggactgacaatttaatattcgcgagtaggttaagggaagccgattcttgtgatgcacggaggtcattcgaattgccgcgaggaatttgggtatcgagatctttattagagccgattctctatcatcacgccttcccgtgcagggtatggccggacatcgaaagaaatcggggacagtttggaacttgcctgctattacatatgaaactgcttgatcatttaaatatcaagaaagttcatgtggttgcggtgtcagccggcgggccaagcggaatatgttttgcatccaaatactcggaaagagtagaatccttaattttgcaaagcgctgtcacaaagcagtggctgacagcgaaggatattgaatataaagttggtcagatcatctttcggccgcctgttgaaaaggccgtatggaagctgatatcggcgcttaacaatcgatttccggaatggatctttaagaaaatgctatcctcctttactacacttcctgctgatcaggcgatgctgaaagtcacggagggagatattgaagaaatgagaaaaatgaacaacagacagcgttcaagtcgagggttcttgcttgatttaaaaaatatagacgatttatctttccatcatttgaaggagatttcttgtccggtattaattatgcattgccgatatgatcgtgttgttccagccgagcatgcttttcatgcaaaaaaactgattcctttttcagaagtctatcaggcagacagctggggtcatctcatttggctgggaacagagggtaaatctgtctcacagaaggtcatcagctttttaaaaaccacatcatcttgatcataagatgaataaaattttaggatcgcagcctacccgcaaatgaagtagtgcaattttttaatcaagagcagaatgatctttccgaacagaactgatgaacgtcgtacaagacttgcaaataagatgaatgagaaatcctccctggccggttttcggagcacaagggaaacttatgtataagaatctattccgatagagggacaggtacgggatgaatcattgattaccgttgcctgcgatttcccaggggggagagagttggtaaacttgatatcatccgcgggtttgctttgcttggcattcttttagcccatagggaagtcgtctttggctgtggatatttcaatttgggcctgctgaatggatatggcgcagtttggcttgcggcaagcggcagcttcttcctaaactcgcgattgaaacgatgcggctatgcaatatggtgaaacgttgcatgaaaaacttaacattttaaaaatccagc

SEQ ID NO: 72 - protein, 284 aa, Bacillus licheniformis
DEKKHRHLLNLRTDNLIFASRLREADSCDARRSFELPRGIWVSRSLLEPILYHHAFPCRVWPDIERNRGQFGTCLLLHMKLLDHLNIKKVHVVAVSAGGPSGICFASKYSERVESLILQSAVTKQWLTAKDIEYKVGQIIFRPPVEKAVWKLISALNNRFPEWIFKKMLSSFTTLPADQAMLKVTEGDIEEMRKMNNRQRSSRGFLLDLKNIDDLSFHHLKEISCPVLIMHCRYDRVVPAEHAFHAKKLIPFSEVYQADSWGHLIWLGTEGKSVSQKVISFLKT

SEQ ID NO: 73 - DNA, 1630 bp, Bacillus licheniformis
  CDS (256)..(1131)
cgctgttcacccatttggtttgttcctcagcctcttgggcgctcgcacatccggcgagccagatcaacaagaagaataaaactgttcgttttttcatccgcttcctccgactttaattgttttttggccattatatgaattcggccagcgttgaatatttcctcttttcagggaaatttccgaagcggcgattcaaaaatccgcaaacttatcttacaatagaaaaagttctgaatgatcgagtagggagagatcgttagtatgaaagtatcggttctgtttgtcttgcttgcggcaattttatggggaacgacgggaacaacccaggcatttgcgccgaaagaggcggcacctcttgtgttcggcgctgtcagaatggctgtcggcggcatcaccctgctcttgttcgcggctttccgcggtcaattgaaacgaagcggctggcccgttaaaacgctgatcatcgcagcattgagcatggcattttaccagcctttctttttttcagccgtcagcctgtcaggaatcgccgtcggaacggtcgtcgccatcggcagcgctccgattattgccggctgcctcgaatggctggtgttcaaaaaggttccgcagacgaaatggtggatcgcaactgctgcagcgatagcaggcgtagccttattattcattccctccgcctcatcgggggggagctttctcggcatactgctcgcacttggcgccggtctttcctttgccgtctacacgctgacaagcaagaaactcctgcaaaagcaaaagccggaggctgtcacaggcaccgtattctttttaagcgctgtattgcttgccccgttgttgtttctgtacgatctcggctggatctcatcggttcagggaatggctgtcagcctctatatcggggtcattgcaaccggagccgcgtacctgttatttacgacaggattggcaaaagtgcccgcctcaacggcggtgacgctgtcgcttgctgaaccgcttacagcgtcgctgttgggaaccgtgcttgtcagggaatcgctgcctcttgtttcctgggccgggatcgccctgcttcttttaggcattttttatatttcctatcagcccaaaaaggataaaataaacgctgaacagatgaaagcgtaaaaaaaacccgcccggggatatacgggcgggttttcatgttgtcttgttattcatccaaaccgatggacaaatattttgtttccaaatacggctcgatgccttccagtccgctttcgcgtccgataccgctttccttcatgccgccgaaaggcgcctgaacggttgacggtccgccgtcattccagccgagaatgccgtaatcaaggttttcggataaatagatgccgcggcggtagttttccgtaaagaagtatgccgctaaaccgtaaggcgtatcattggcgagcttgaccgcttcgtccagcgttttaaaagacgtaatcggcgcaacggggccgaatgtttcctcatgcatgatcgtcattgaaggatcaacatccgtcagcactgtcggatggacaaagtagcatgatttctcatcatcgctttcatattcggcgccgatgagaactttcgcccctttattcaccgcgtcattgatttg

SEQ ID NO: 74 - protein, 292 aa, Bacillus licheniformis
VSMKVSVLFVLLAAILWGTTGTTQAFAPKEAAPLVFGAVRMAVGGITLLLFAAFRGQLKRSGWPVKTLIIAALSMAFYQPFFFSAVSLSGIAVGTVVAIGSAPIIAGCLEWLVFKKVPQTKWWIATAAAIAGVALLFIPSASSGGSFLGILLALGAGLSFAVYTLTSKKLLQKQKPEAVTGTVFFLSAVLLAPLLFLYDLGWISSVQGMAVSLYIGVIATGAAYLLFTTGLAKVPASTAVTLSLAEPLTASLLGTVLVRESLPLVSWAGIALLLLGIFYISYQPKKDKINAE

SEQ ID NO: 75 - DNA, 2140 bp, Bacillus licheniformis
  CDS (501)..(1637)
agctgccggggcaaatagagcgcgctggcttgcagataatgctgctggaagagatactatgaatacaagtgattatttagattttaatgaagaaaacaaaaacaatgataatggaaaagattacagtaatgcctacactgatatggactgtgaggcgatgactgaagatattaatcatttgaaatctgccaatcctgaggtgtatcaaaagctgcagaagatggacattaccgctgcggcgggatacagaacagaggatactgtaagtttttccccttactataccgcaagcggaaaacataaaataaacagtgatgatatcgtttcggtcgaaagtcaacacggtgacatattaggcgatctcattgataaaaagccagaaattgaagtaagaggttccggtgtaaccaatcctggacatatttatgaaattgaagactctgaatttgttgacttgattcgagaggtcaacaaaaaagaagcagaataggagaaggtcgatgaaaaagaaagggtttataagtatattttttttaatagtgtttctactgctcgccaccaccggctgcggcaaagatgatgttcaggaagccatctataaaaaaggcttgcccaaagaagacagtccagcatttagagaatttatgagacatgaacttgatttagcgacagacgcaactcttagttatcaaaatagtacatatacgattatgcgcagtgataaaaaggggctacggtactatcaatatacagatcaagaagtagacgatttttacagtccctttctttcggctaataaatatcctgcgacaaaattatatgatttgaaaacaactgaatttttaactaaagaaaaacttatccacaataaacttgaatataatctgccggaaatgacattagataaaaagaatgttctaaaagtgaaaacaaaaagcggagaaaaaaaaatagagtttccatcagccaaggataaaaaagtacatctggcgttagcagctgttagcaaagacagcatgcttatacaagtggacgtatatgaaaaatttaaaaatggtgaccttggagacagacaaatatattatctttttttaaaaagtgatctttcaaaataccggattgttaaagaagaggaattaaattcaacaattgagtctgggaaactgaaggaatacttatccgtatttccaaatgtagcgaaggatggagcatatcgtaagttatttgataaatacatttttgatgaaaagaaaaacaaagttaggaaaatcaaaaacactgatattctgagcaaagacggtaagtatgtttatattaacggagcaaaagaaaaagaaacaaatgtaatgcctgatggtatccaacagatacaaacaatggataattatctaaaaggaaatgaaaaatatgaagctcaatttaagattgatttcaaacaaattgcaaaagagatggatttaaacgcgggtgatgcgaggatagctaatattcattattttaataaagattatgtagttttgtatatttcttatcatgggaagacaattggtacagcaggttctgttaatgtacttattgatttacaaaaaaacaaacaacagccaacggcttatttagttgatttaggaattgaatcatagagggactgaagagtttttatgcagtccttttcttatttgacaaaggtaggccacaaaattgggacaagccttctgcttcctacttccttatccaatttaagagaagttcttgcagaaagcgtacaatgacgaaagaatgcagcagcgtttggaacactcgttaatgctcgtttcggaagcggacggaaaaatcgtcggctttgccaactactcctttgtcagagaaggaggggtagcctatctcgcagccgtttatttagctccggaataccagggaaaaggcatcggaaccgcattattggaagaggggatgaaccatttaaagggagtgaaaaagatctttgtagaggttgaaaaagaaaaccgcaccggaaaaaacttttacaaggcgaagggttttgaggatgtcgccgaatatgatgaagatttcgaagggcatatcctcaaaacagtcagaatggccttgcacgtataatcccgctttcacttcgtaacttgga

SEQ ID NO: 76 - protein, 379 aa, Bacillus licheniformis
MKKKGFISIFFLIVFLLLATTGCGKDDVQEAIYKKGLPKEDSPAFREFMRHELDLATDATLSYQNSTYTIMRSDKKGLRYYQYTDQEVDDFYSPFLSANKYPATKLYDLKTTEFLTKEKLIHNKLEYNLPEMTLDKKNVLKVKTKSGEKKIEFPSAKDKKVHLALAAVSKDSMLIQVDVYEKFKNGDLGDRQIYYLFLKSDLSKYRIVKEEELNSTIESGKLKEYLSVFPNVAKDGAYRKLFDKYIFDEKKNKVRKIKNTDILSKDGKYVYINGAKEKETNVMPDGIQQIQTMDNYLKGNEKYEAQFKIDFKQIAKEMDLNAGDARIANIHYFNKDYVVLYISYHGKTIGTAGSVNVLIDLQKNKQQPTAYLVDLGIES

SEQ ID NO: 77 - DNA, 1387 bp, Bacillus licheniformis
  CDS (501)..(884)
aaagtcaaatatacgctcgaccatacagtgggtcttgcagtggattccgtaaatatttacgttcaaggagtacgagtgacgaacccgtagttaggaggaaaacaagagtgtctatacgaaatctggatggaaaagcttttgcagatatgattctgtacggcgcacaccatctgtctcaaaacgcaaatgtagttgatgcgttaaacgtatttccggttccggacggagatacgggaacgaacactaatctgtcgatgacatccggtgcgaaagaagtggagcaaatcgacaccgccaatatcggcaaagtggcacaaagcctgtcaagggggcttctgatgggggcgcggggaaactcgggcgtcattttatcccagctgttcagaggctttggcaaatcgattgaacagaaatcggaaattaacgcgaaagaatttgccgccgcgttccaggccggagtggacaccgcctacaaggccgtcataaacaagcttctacagatgtctaccagcagcattgtcgttctcttgatttgcgccgcgctcatcatctacgcggtcgcttcatacatctatcagcagcgcattatgaaaaccttgacagaagaagaattccgggcaggctatcgcaaagcgcagctcatcgatgtgcgcgagccgaatgagtatgaaggcggccacattttgggtgcgagaaacattccgctttcacagcttaagcaaagaaaaagcgaaatccggcctgacaaaccggtttacctgtactgccaaaacaacgtcagaagcggaagggccgcccaaacgctccgcaaacacggctgtaaggagatttacaacctgaaaggcgggttcaaaaaatggggcggaaaaattaaaacgaaaaattaataaccgaagctgtctctgctatggaaggcttcagttgagtccagcatcctaaagcggtttaacgttttaggatgttttttttgcatccgggaggattcgggtgatgagcggttatccctttccggcaaaaataagccggcgagatgggttcgccggctttgttcgttattttttcaagtcttcgattgaattgacatctttcatatatgtcggaacgacaaggccaatttttacgcctgtcatgctagtaccgatatcttcgtatttgcctttgtatttttcagcatatgttttattgcgttgcggcagccatgcagcaagtgaagcatcgacgcttccattttgcatgccaggtcacatcgggcctgcttctacttgggctgagcgtacggtgtatccctagtcttcaagaactttgcgatgacattcgtgctcgcattttcgctgtcccatgccacatagccgagcttaattttttcaccgtccgcttatcgacgccc

SEQ ID NO: 78 - protein, 128 aa, Bacillus licheniformis
MSTSSIVVLLICAALIIYAVASYIYQQRIMKTLTEEEFRAGYRKAQLIDVREPNEYEGGHILGARNIPLSQLKQRKSEIRPDKPVYLYCQNNVRSGRAAQTLRKHGCKEIYNLKGGFKKWGGKIKTKN

SEQ ID NO: 79 - DNA, 1486 bp, Bacillus licheniformis
  CDS (501)..(983)
ggcaggctgctccgctcagagaaagacagcggaacggtcgttattcttgaccgccgcatccgaacctcttcctacggcacggtgtttatgaaggctctgccccctgcaaaagtcatggagcctactttccttgagcttgaagcctacatagccgggaaaaacggctaaaagccgcataaagcggctcttaaatggtgtggattaaggttttattttttaggctgtttatttaaacggatatcccgttgtaacaactagtatggcttttgctacaaagagtatgaattacaattattgtttcgttcggaggtatttgaaaaatggaaaacaaaatcgaaattctatctactgtaagcgtcgagcactcagaagacctgtataaaatcgttgatcttttgaaccgtacgctcaaacgcgatgatctcatgttcggcctcgctctcgatgaagaagaccaaaaacaggccatttttacgatttatcgtacttaggagcagaaaatgggcaaaaaaacattaattttcatactgatatttggtattatctttttaacagcacttcttgcgggagcgaatgtctaccgtacggcaatggatcagaaagaaaacggccacgagcaggctgccgaaacagccaggcaggaagccggcttaaaacaagttgacagcgtggagacgtttgtcggtaaagaaaagcagtacattgttacaggggcagacaaaaaaggcgacaaaatgtatgtttgggtgcctgctgacaaaaagcagaaaacgctttacaaaaaagcatcagccggcattaccggccgccaggctgcaaaagctgttcaggatgagggcctgatgtctgagcttaaagaggtgcaccttgcaagggaaggcaatgttctattgtgggaagttacatacttaaataaagatgggcagtacagtttaagctatgtggactttataaacggaaaaattcacaaaaatattacgccttagacgaaacagggggaaatcgagttgaatctagctaaaagagtatcagcgttaacaccatctgcaacattggcaatcactgcaaaagcaaaagaattaaaagcggcagggcacgacgtcatcggtcttggggcaggtgagccggattttaatacgcctgagcacatcattgaagcggctgtccgttcgatgaacgaaggacataccaaatacacgccttccggcggtcttgcggcgctgaaagacagcatccgcgataaattcaagcgcgatcagggaattgaatacagccaatcggaagttattgtgtgcacaggtgcaaagcatgctctttacaccctatttcaagtgctcctcgacgaaggggacgaagtgattattccgactccgtactgggtcagctatcctgaacaagtcaagcttgcaggcggcaaacctgtgtttgtggaaggccttgaggaaaacagcttcaagatttctccggagcagctcgaaaaagccgt

SEQ ID NO: 80 - protein, 161 aa, Bacillus licheniformis
MGKKTLIFILIFGIIFLTALLAGANVYRTAMDQKENGHEQAAETARQEAGLKQVDSVETFVGKEKQYIVTGADKKGDKMYVWVPADKKQKTLYKKASAGITGRQAAKAVQDEGLMSELKEVHLAREGNVLLWEVTYLNKDGQYSLSYVDFINGKIHKNITP

SEQ ID NO: 81 - DNA, 1993 bp, Bacillus licheniformis
  CDS (501)..(1490)
gggcttgccggaatggaaacgatccttctgtttgcagcaggcattattttaatcattttagagatttttctgccgggcggaatagcagggattgccggcctgatcgcaattgttgcgagcctctttttagcttcgggaagctttaaggtcatggccgtctccattttgattgcaactgctgtttcgatagcggcatccattctattgacaagggtgttgggtaagcgtatgaaattttttaaaaaattgatcttaaccgactcgacaagcacagaaagcggatacgtgtcaaatgaaagccggcgcgatttaattggcaaaatcggcgtcacgtatacaccgctcagaccgtccggaacggtcatcatcgacgatgaacggcttgatgttgtatctgaaggctcgttcaccgcaaaggataagaaagtgaaagtggttaaagtggaaggctcacgcattgttgtgagagaattataaattacatttttaggaggaatataatggatccgtcaacactgtttcttttacttattatcgcagccggaatcatcctactagctgtcttctttacattcgtcccggtcatgctgtggatctcggctttggccgctggtgttaaaatcagcattttcacactgatcggaatgaggctccgccgcgtcattccaaaccgcgtggtgaacccgctcatcaaagcgcacaaagcgggacttgatgttgccatcaatcagctggaaagccactatcttgcagggggtaatgttgaccgggtcgtcaacgcgcttatcgctgcccaacgtgcaaacattgaacttacattcgccagatgtgcggccatcgatttagcgggccgtgacgtgcttgaagccgttcaaatgagcgttaatccgaaagtcatcgaaacgccgtttattgccggtgtagcaatggatggtatcgaagtgaaagcaaaagcgagaatcacggttcgcgctaacatcgaccgccttgtcgggggagcgggcgaagaaacgatcattgcccgtgtcggcgaagggatcgtttcgacaatcggttcttccgataatcataaaaaagtgcttgaaaacccagatatgatttcacaaaccgtattgagcaaagggttggattcaggtacagcgtttgaaattctatcgatcgatatcgctgacgttgacatcggcaaaaacatcggagcgattctgcaaaccgaccaggctgaagccgataaaaacatcgcccaggcgaaagcggaagagcgccgcgccatggcggttgcgcaagaacaggaaatgcgcgcccgcgtcgaagaaatgcgcgccaaagtcgtcgaagccgaagccgaagtgccgcttgcaatgtctgaagctctccgcagcggaaaaatcggcgtcatggactacctcaatatgaaaaacatcgacgccgacactgacatgcgcgattctttcggaaagatgacgaaagaccaaaatgaagaggatcataaataaacaagcccctgtaaaaaggagggagctcattgcttgatatcctgttcgacaatccgattatcatggcggccatcatcgcagccatttccttcatattcaacaagctcggaaaaaacgatgaaaatgaagaagcgaagcgaaaaccggcgcctgaacagcagaggacgcagacgccgaagccgaaacagacggcgcagcaccgtcctgcaaaaaataaaaaccagcggccggcagcggcagctgcaaacagcgcagatatggaagcagagctccgcagaatcaaagaagatgccgagcgttccatgccggccgttgaacggaccattaaaaagcagagcagccgggtgatcaaccggaagcaagagctgctcgacatgaataaaaaaacaatagttcaaggcattgtcctcagtgaagtattcggccctccgcggtcgagaaagccgcattacacaatgaggcgccggcctaaaatttaagtattagaacccccttctcac

SEQ ID NO: 82 - protein, 330 aa, Bacillus licheniformis
MDPSTLFLLLIIAAGIILLAVFFTFVPVMLWISALAAGVKISIFTLIGMRLRRVIPNRVVNPLIKAHKAGLDVAINQLESHYLAGGNVDRVVNALIAAQRANIELTFARCAAIDLAGRDVLEAVQMSVNPKVIETPFIAGVAMDGIEVKAKARITVRANIDRLVGGAGEETIIARVGEGIVSTIGSSDNHKKVLENPDMISQTVLSKGLDSGTAFEILSIDIADVDIGKNIGAILQTDQAEADKNIAQAKAEERRAMAVAQEQEMRARVEEMRAKVVEAEAEVPLAMSEALRSGKIGVMDYLNMKNIDADTDMRDSFGKMTKDQNEEDHK

SEQ ID NO: 83 - DNA, 1705 bp, Bacillus licheniformis
  CDS (308)..(1237)
tggatgaagggcttcattctcaatctcttgtcaacctttccgctgatctgtacggtcctatggcttaaattcaccagtaaggaaaagacctcattaaacattatcgtattcatttgttcactgctgagtttcggcgtttcgcaatcccctttagggcttctctttccatggtcttttcctgtgacggccctcattgcaatggagaagtcagttgccgttcttatcggttcgattgtttggttcacggcggtttcgcagctctttttttctcttctattgaaacagatcaggccataccaaaaaggaggaatacaaaatgagtcaagtcgaatttgaaggtgtaagtaaacgaataaaaggcagaccaattgtccaaaatatcacatttcaaattgccccaggtacaatttttgggctgctcgggccaaacggcgctggcaagacaacacttatcaaaatgattgtcgggatggcaaagccgacatcaggagatatccgcatcgacggctattcagttaaaagcaattacgaggaagcggcagcccgagtcggttctgttgttgaaaacccatccttttatgagcacttaacaggataccaaaaccttaaatatctcggcggattccacagccacgtgtcaaaggagcgcatagaagagatcgttcagcttgttgatttgacaggaagtattcataaaccagttaaaacgtattcattaggcatgaaacagcgtttgggccttgccgtcgcgctcttgcatgatccggaatttctcattctcgatgaaccgacaaacggccttgatcctcagggaatcattgatttgcgcgaacaccttcagtacttggcgaaaaccttcaacaaaacgattttgatttcgagtcatcttctgtctgaggttgagatgatttgtgatgaatacggcgtcatgaaaaacggagaactcctgcaaattaagagcaatcaccgcgataccgatacggttcgttatcggcttacattaaacggccacgccgatgaagcggctgacctgttgaatgagtaccagtatgcaggcggtctcacggaagataaaaatgagatttatgtcctttgcatggaagaagacattatgaaagtcgttaatctgttaatggagaacaaaataagagttctgcatatgaagcaggaaaaacagtcgatagaacaaagctttctggaattgatcaataaggggttaccggcattagggtcttgaaaaatgaactttacaggctgatggtgacgaaaagtacctggattgtgttaagcttgctgcttgtcatgacaatcgctgttgcatggatggtcagcaatggcgaaaaggagaaggagacaggtaactggaaagagcaattaaccgttcaaaacgctcagtatgaaagagaaatgagagagctgagcccagcggttcccaaataccaatttttaaaagaagagatcgcggtcaatcaataccggcttgagcataatttgccgccttctgcgaaatacaatgtttggacgatgctgaaggagttaaaaccgatcacaacattaatcgcgttgattgcaatcgtgctggcagcgaactccatcgcgcttgagcacagcaaaggaactattaaatttgcgattgcaacaccggtcaagcgttggcattatctattggggaaatacttgtcgatcttgctcaacactgtattta

SEQ ID NO: 84 - protein, 309 aa, Bacillus licheniformis
EYKMSQVEFEGVSKRIKGRPIVQNITFQIAPGTIFGLLGPNGAGKTTLIKMIVGMAKPTSGDIRIDGYSVKSNYEEAAARVGSVVENPSFYEHLTGYQNLKYLGGFHSHVSKERIEEIVQLVDLTGSIHKPVKTYSLGMKQRLGLAVALLHDPEFLILDEPTNGLDPQGIIDLREHLQYLAKTFNKTILISSHLLSEVEMICDEYGVMKNGELLQIKSNHRDTDTVRYRLTLNGHADEAADLLNEYQYAGGLTEDKNEIYVLCMEEDIMKVVNLLMENKIRVLHMKQEKQSIEQSFLELINKGLPALGS

SEQ ID NO: 85 - DNA, 1371 bp, Bacillus licheniformis
  CDS (501)..(878)
aaggcttcctgatcgcggattttaatataaggctgttcgacattttctacattttccacatattttttgaaagtctccgtcttttcttttccatctttcacgtatgctgctttcagtaatggtgctttgtcggattcgctgtcattcacgtaatcaaaccatacgagatcgtatttttgaatggattggtcatctgcgacctcctgtgaacggtctgaagcggatgatgaacatcctgataagggaacggctaaaagcatcgcagccgcggataaagagatcagtttcgattttttcactgtgatcatcctattcatttcggtttcgcttttatatacgaacgatccgggcaaaggtgtcatctattcaaaatagattggcagaaaacagggcgtaacaattgcattttaaacgtaaacaaactgtaaaataccatttctatgaaaaaaggtataatttgaatgtcagaaaaaaatcccattcacggaggatatttttatatgaagaagatacttttttctgtttttgttttggcaggcagcttgctattggcttttaattttgccggtgaagcgagtgctaaaacgaaaaaagtcagcggctatatcacttggtacaacggagtgggcaaaatcggcgctgacggcaagaggctcggccattgggactgcgccacaaagatgggcttcgatgttccgagaaaaggcacaaaaataagagcctattcaaaagcaaaaccgcacaaagtcattacagtctataaatatgatgtcggcagaatgccgggcgctgttttggatgtaagcccgaaagcttttagagctttgggatttccgacaagcaaaggaaaggtagccggacattatacatataaaaaataggagaaatgaagcaagaaaaatcgttttcttgcttctttcaattggcggggtcgaatatgaaaaaagtttcagttgttttgttggcggcagtcattttagccgcaggcgcatttgcggccgtccgctatttcgtcccggaaaaagcggagccggcaaagagcggcggttcagacctgcttgtatcgataaccgatcagaagctgatgaccgcttactatgaaaatcaaaataagctgtatgaagaaaagatgacggattatccggctatggcattagaccggaaaaaacgaattctttactatacaaacaccgataacagcaatgtgaagcatttgatcaggctggatttacagtcgggcaaaaaaacaaccctatattcaggagatgaatatgtcgacgggctcagtttatcggcggacggttcgaagctgttcatgagatacaaccttgcggaggagaggaattttcaccttgcttcctttgatttaaa

SEQ ID NO: 86 - protein, 126 aa, Bacillus licheniformis
MKKILFSVFVLAGSLLLAFNFAGEASAKTKKVSGYITWYNGVGKIGADGKRLGHWDCATKMGFDVPRKGTKIRAYSKAKPHKVITVYKYDVGRMPGAVLDVSPKAFRALGFPTSKGKVAGHYTYKK

SEQ ID NO: 87 - DNA, 1957 bp, Bacillus licheniformis
  CDS (501)..(1454)
ttggatactgagccgctttatctggtgcttccagccgaccacccgcttgcagatcggaaagaagtcgcgatccggtcgattgcacacgaagactttgtctgttttaagccgggctatggtcttcgatatgtgtttgatcaaatgtgccggggactgtccatcagcccgaagcttgcttttgaaggggaagaagtgtcgacgattttgggactagtatcagcagggctcggtgtagcaatcctgccgaaaacggcggagcacgtccattctccagtggcattttgccgagtgtcagactaccgttctgagaggacgatcggtctcgccgtcctgaaagaccattatttgtcgccggcggcacgcaactttaaagaatttgtaattgaatactatcgccggaacgaacggtctgatcagccgtaactcaaataaggacttctcaagatgacaaatatcctgtatattgataatgataattattatcaattggaggattaaatatgacgaaaaagcaatattcttatatattcacccttttactcgctttcgctgtatttctttcaggctgtcaaagcggccagaaacaggctgcatcagagaaaaatgaagagaaaacaagagtggtgaaaaccatcaacggaaatgtcactgtaccggctaatccgaagcgcgtcgtgacgattggctatgcgggaaccatgcttgcattcgggatcaagccgcttggagaaacgggaaagtacctcggaagtccttatattaaagatcaagtttcaggaataaaggatatcgggggaaaagacggtttttcagtatctgtggaaaaagttcttgaacttaaacccgatttaatcgtatcgatgacgaacgattcaaaagaatatgaaaagctgtcaaaaatcgctcccactgtcgtctatccgttcggcacatttaaagatgcacgcgatgaaatgaaaacgtttggcaagctgctcggcaaggaaaaggaagctcgggagtggacgaaaacgtttaatcaaaaaatgaaagccgcccgcgcgaaaattaaagatgcatctgtaaaaggtgaaacgttctctttaatcggcgcatatgcaaaatctttatatgtctacggggcatacgggtatcggggcggagaagcgatctatacgcagctgggactgacgccgcctgaatctgttaaaaaggatgccattgatacagctgacggatataaagccatatctttcgaggtcctgccgaaatatgccggagactacatatttgtcgacgaatcatacaacggaaagcttgatcaggacaatccggtttgggcatcgcttgacgcggtgaaaaaaggcaaggtctttttcctcgatccggacagattttggccgtatgatccaaacgctgttcaggcacaggccgaagaaatcgccgacatgatttccaagaaagcgaaaaataaatagaaaagcggggagccgaaaagaatgatccggcttcccgctttttcatttttcataatgctgaaattgaatatccagtgtccggaggtacgtttgcaggcccgcatcttggatggggatgatataggcggcttcatctgactcattatggtgggaatgccataatcccggcggtgtaatgaaggcttttccggttacccagtcaattcgtttcggatcaatgatttcctttgtggccggatcgattttgcttccgactaatgtatacgtgccgggtgcggcataggcgacaaaatcgagagccaccgacttgtggctgtgaggagcttgattggagccgggaggcacgatgccgaacattgcccacaatacatgggtgatcgtcagcgtttgatcgaatatttcattgttcaagagaacggaaatgcggttgcgataacgggcgtcaggagcggcggccgcttcagccaattttgcttttgactgttcagcggtgtagagag

SEQ ID NO: 88 - protein, 318 aa, Bacillus licheniformis
MTKKQYSYIFTLLLAFAVFLSGCQSGQKQAASEKNEEKTRVVKTINGNVTVPANPKRVVTIGYAGTMLAFGIKPLGETGKYLGSPYIKDQVSGIKDIGGKDGFSVSVEKVLELKPDLIVSMTNDSKEYEKLSKIAPTVVYPFGTFKDARDEMKTFGKLLGKEKEAREWTKTFNQKMKAARAKIKDASVKGETFSLIGAYAKSLYVYGAYGYRGGEAIYTQLGLTPPESVKKDAIDTADGYKAISFEVLPKYAGDYIFVDESYNGKLDQDNPVWASLDAVKKGKVFFLDPDRFWPYDPNAVQAQAEEIADMISKKAKNK

SEQ ID NO: 89 - DNA, 1432 bp, Bacillus licheniformis
  CDS (501)..(929)
tccggattatcaaaagctggagacaacctttaccgcgaaacattgagttcgggagatccgcaagtcgttgtacctggggaaggcggctcaggaaaaattcaaacgagtgcgcttgaaatgtcgaacgtcgacctttcagaagaattttccgaaatgattatcgcgcagcgcggcttccagtccaatgcgaaaatcattacaacctctgatgaaattcttcaggaactcgtcaatctgaagcgataggagggaaggaggcgccctcgtgaaggcgcctcttgataacacatgatcaaagttacgcgattaaacggacagccctttattctgaatgcactattcattgagcaaattgaatgttttccggatacgacaattacgctgtccaacggaaaaaagtttgttgtcaaagaagatgaagatacagttgtggatacaatcgtgtcattctatcaaaaaatccaaatactttcttgtgaccaaagaattgaggaatctgaatgaataaaaaacttctaggaattatgatgacgattattttggcaattgctgtgttgggaaccgctgcgttctttgtcatcaagggaagcgcaagtgaaaaagatcaaaacgcagaaccttcgatcgatgaagtggtcgaatcttcagttgaagtcgccgaaatcacgacaaacttgaaatcagacaatgtagtccgtttgtcaatcaagcttgaaaccgattcgaaagaggcgaaagaagagcttgaaaagcgggatttccaaattaaagattcagtcatctcccttttggcgaacacgaacgcagatgagcttgaaggacaaaaaggaaaagaaaaatttaaagaacagctgaaagaaaagctgaacacgaactacatgaaagagggaaaagtgaaaactgtgtacattacctcctttaatctgcagtaggaacatagatgacagaaccatggaggtgaaaacagatggcaggagaagtgctctcccaaaatgaaatcgatgcactgctttcagcgatatcgaccggtgaaatggacgccgacgagctgaaaaaagaagagtccgttaaaaaagtaaaagtctatgactttaaacgggcgctccgcttttcaaaggatcaaatccgcagcttgaccaggattcacgataactttgcaaggctgctaacgacttatttctcagctcagttgagaacctatatccaaatctcggtcagctcggttgatcaggttccgtatgaggaattcatcagatcgattccgaatatgacgatcctcaatctgtttgaggttcgccctcttgaaggaagaatcatgatggagatcaacccgaccatcgcctatacgatgatggaccgggtgatgggcgggatcggctcgagccacaacaaaattgacagcatgacggagattgagacgaaaatcatgtcc

SEQ ID NO: 90 - protein, 143 aa, Bacillus licheniformis
MNKKLLGIMMTIILAIAVLGTAAFFVIKGSASEKDQNAEPSIDEVVESSVEVAEITTNLKSDNVVRLSIKLETDSKEAKEELEKRDFQIKDSVISLLANTNADELEGQKGKEKFKEQLKEKLNTNYMKEGKVKTVYITSFNLQ

SEQ ID NO: 91 - DNA, 1366 bp, Bacillus licheniformis
  CDS (488)..(874)
atggcttgactgccgaaagctcggattgtcggatcaggacatcaaacggcttctccttcataaaggaaagctgattcttgagccgggaccgaagtacggaccgggcggagaaggattcgtcagaatgaatgtcggatgttcgctctctgttgtaaaagacggactccgacgtctgaagaccgctttttcgtaagcgttccggctgaaagccgggcgcttctaagagcgtttatggatggtttcattcaattctctttccagcttttccgctttttcagcttcttttttggaatgcttgataatcagccggaatacagcgatcgcgatgataaagaaaacggccagcgtaataaaagaagggatatattctcttttgtcttcaggaaaatagagcataaactgaatcagaaacggcgccatttttcttcctccctgaaatgatttttttaccatttatttattatgataccattaggaggcagatgcagtgaacaaccaatttcaagtcggagatcgcgtaaagggcttttataaaacaggcgtctacatcggcgaaattacggatgttaaaccgatgcactacctggtcaaaatcctcgccgtgctgacccatccgaagcagggcgaccttcatcatcccaatcgggcagacgtccctttttttcatgaacgaaaagcgctcgcttacggtgaacagacgaatatcccgcaccgcatggtgaagccgttcgatgaagctgtaccggattatgcggattcgctccgctcagctttgagccgcttaaaaacggatctgcaaaacgattcgtccgaatacgcggcaaaatcgcttgagcttattcatgggcttgaaaaagaatatttcctgcacaaataacccaatctgtttgtcagattgggttttttatgtggcgtgcggaaagacttttgagaggtcaacccgttcgccgatcgtcgtcggcttcggattttccaaatacttcttatcccgttctacgagccgaaacaacttatacgttgtcatcgcgtcgtcaagcgctttatgctgttttcccgttcctgaatcgccgtactcttccgctgccttccacaaattcgtcaatgttttgtcgccgaaaaattccttgtactccatggaaaggtccctcatctctcctttaaacggaaacggaacatggttgaacatgcaattttgcttcagcactttcatatccatgtttccccatgtaatgatgacgctgtttcggtcaggatcaagctcccgcagcttttcaatcagcgcgttaaacgtgatgccttggtcaacctgttcctgcgtgatgctgagaaaatttttgcagcgcctcgttaatttagggaacttctt

SEQ ID NO: 92 - protein, 129 aa, Bacillus licheniformis
VNNQFQVGDRVKGFYKTGVYIGEITDVKPMHYLVKILAVLTHPKQGDLHHPNRADVPFFHERKALAYGEQTNIPHRMVKPFDEAVPDYADSLRSALSRLKTDLQNDSSEYAAKSLELIHGLEKEYFLHK

SEQ ID NO: 93 - DNA, 1909 bp, Bacillus licheniformis
  CDS (501)..(1406)
gcgttgccggagatgaaatggatgaagcaatcattacttatattagaaaaacatataacttgatgatcggtgaccggactgcagaagcgatcaaacttgaaatcggttctgccgaagcttctgaaaacggagaaagcatggagatccgcggccgcgatcttttaacaggcctgccgaaaacgattgaaatcactgaaaaagaaattacagcggctcttcgcgacactgtgaccgccattgtcgatgccgtaaaaaatacgcttgaaaaaactccgcctgaactcgcggctgatattatggaccgcggaatcgtccttacgggaggcggcgcactgctgcgccacctggacaaagtcatcagcgaagaaacgaaaatgccggttttaattgcggaagaccctcttgactgtgtagcgatcggaacaggcaaagctctcgagcaaattcatctatttaaaggcaaaaattaaggacacagggaatagaagaggtgtataatcatgccgcagttttttacaaataaacggttgatgcttttactcctttgtatcatcattttagtggcaatgattggattttcgttaaagaatgaccggaatgcaacttggcccgaaaaatttattggcgatacaactggtgtattccagacgatttttcatacgcccgctcaattttttgcgggcttctttgaaaatatcgaagacttaaaaaatacgtacagcgaaaatgagcgcctgcggaaaaagctcgacggccagacacaatacgaggcaaagctgcaggagcttgaaaatgaaaataagtctttaagaaaagagctcggccatctgaaatcaattaaagactacacgccgattctggcgaccgttatcgccagaaatcccgataagtatgagtggtggaacctgattacgatcaacaaaggttcaaagcacggcgttgagaaggatatggcggtaacagatgaaaacggcaacttgatcggaaaaatcaaaagcacaaaagtgaacaatttcacttccaccgtccagcttttaagcgcaacagacagaaacaacagaatctccacagttatcgctgcagataaaggcaagaaaacggtgaacggaatcatcaacggctacgactcagataaaaaggcgctttccatggaaatcatcgagcctgatgaagacagggaagtgaaaaaaggtgacctcgtcgaaacttccggtgcgggcggcgtttttcctaaaggcctgacaatcggaaaagtgacagaggttgaaccagattcctacggtttgacgaaaatcgcttatgtagagccggcagccgatatgtataaccttgataacgtcatcgtcgtcgacagaacgcttgatacggtggatgtcgacaagatggacgatgaggaggaagggtcgtgaaacgcttccttcttcccgtcgtcatgatgtttgttttagtatctgacagcgtctatgcggattttgtcaacttgccttttgtgacggaagaacagcagctcatcccgcgttttctgctgcttgtcttagtttttatgacggcttatgtcaatcagccttttgccattacatatggatttattttcggactgttatatgatattaattacaccgaccttttaggtgtatatatgtttggttttgccggtatttgctatttatcgtcaaaagcgttcaaagtattgcagacaaacgcgctggtcgtcatttttatttcgctgctcgccgtctgtgttcttgaattttaccaatatggcgtgcagatgctgatacgtccggaaattatgccgttccatcaatttgtgctcggcaggctcctgcccacgcttgcgctgaacgccgttggcggccttctgctcatttacccgttcaaatggttttttaccagtcttaagaaagag

SEQ ID NO: 94 - protein, 302 aa, Bacillus licheniformis
MPQFFTNKRLMLLLLCIIILVAMIGFSLKNDRNATWPEKFIGDTTGVFQTIFHTPAQFFAGFFENIEDLKNTYSENERLRKKLDGQTQYEAKLQELENENKSLRKELGHLKSIKDYTPILATVIARNPDKYEWWNLITINKGSKHGVEKDMAVTDENGNLIGKIKSTKVNNFTSTVQLLSATDRNNRISTVIAADKGKKTVNGIINGYDSDKKALSMEIIEPDEDREVKKGDLVETSGAGGVFPKGLTIGKVTEVEPDSYGLTKIAYVEPAADMYNLDNVIVVDRTLDTVDVDKMDDEEEGS

SEQ ID NO: 95 - DNA, 1450 bp, Bacillus licheniformis
  CDS (121)..(951)
gcatgaaagcctgccgacccggcaggtttttttacgtttatgaccagaggcatttttcattgattaaaggaatatccgtctttttcacgaattgatataaaaaagtgaggaggacaaaaaatgacacatagcgcattaaagcatttagattatcacaattgggcgaatcaaagggtgctcacccacctgaaaagcctgcctgaagagctgttcacccgggaaatcaaaagcgtttttcaaactgtatctgaggttgttacccatatgtgcggcgctgacgaccttaggctgaaagataccaccctcttaaccagaaagtgtgggggaaagtatacccgcagaaccgttcaaaaaatgaagccaaagtttaggttgcagtgtcagtttaagaagaagcgccaaaagtacatttgtggtgaaaggaataatattgggcggaacactgtcaatggtaattttaaagcaagccgatttaatgaaaaatgggtaaccgacattacctacttacattatggctccgatatgttatatttatcaacgattatggacttatataacaacgaaatagtggcttacaaaataggtacgagccaagatattaacctagtattagacacattgagggaagctgtagaattacgtaaaccagtagggttacttcttcatagcgaccagggatctgtctatacttcacatgcatatcagaatttggccaaagaaaaaggcattaccacaagcatgtctcgaaaaggaaactgccatgataatgccgtcattgaatcctttcactcctcgctaaagtcggaaggatttaacgctcaaagtagagcatctatatccaattctaaagtagtacaaattgtaaatcaatacatgtatcgatataatcatgtacgaattcaggcaaaattaaactacctgtccccactggaatacaggggacaggcagcataggtgttttttctaagtctcattttaacgggtcagttcatctttacatgccgggtttttgctttattcaggctgcttcgcgtccgcttcaagccgggccactgctccaggcgacgctttttccaccgctctggcggctatgtcgtaagcctcttcatactgatatgcgtaaaaacagttttctgcttctttcagctgttcggaaaggatacggtcctggcttctgaagcggttgccatattgaatgatgcgttcgatcagcaaaaccagttcaaccagttcgtccgtctttgttttcacttccgtgacaagctgttccgcctcttgaagacgttcgttcaccgcatccatgttcagcggcagctcattcaactgttctgtcactttctgcacagtcgtctgcgactgtcggatcttttcggttatggcctccgggatgcctggaacattgcttttctccaggctgcgcgccgtatccttgattgtctgcttcaattgc

SEQ ID NO: 96 - protein, 277 aa, Bacillus licheniformis
MTHSALKHLDYHNWANQRVLTHLKSLPEELFTREIKSVFQTVSEVVTHMCGADDLRLKDTTLLTRKCGGKYTRRTVQKMKPKFRLQCQFKKKRQKYICGERNNIGRNTVNGNFKASRFNEKWVTDITYLHYGSDMLYLSTIMDLYNNEIVAYKIGTSQDINLVLDTLREAVELRKPVGLLLHSDQGSVYTSHAYQNLAKEKGITTSMSRKGNCHDNAVIESFHSSLKSEGFNAQSRASISNSKVVQIVNQYMYRYNHVRIQAKLNYLSPLEYRGQAA

SEQ ID NO: 97 - DNA, 2312 bp, Bacillus licheniformis
  CDS (501)..(1925)
atgattgctgacattgaagactatatcggttttcatattcctattattgaggagccgtcaaaagaagaaattgcacgggcaaaagcggcgtttcaaaagaaaatcaataggaagccggagcttaaacaggacaagagcgaatcgttaaataaggaaatcatgaggctctactttaacgggggaaaaaagaagaagcttagagctgttgatttcgtcggaacgattgctaaaattgacggcgtctccgccgaggatatcgggattatcacgatccaggagcaaggttcattcgttgaaattttaaacggcaaaggtccgctcgtcttagatgcgatgaaaaacacgacagtgaaagggaaattgctgaaagtgcataaagcgaggaaataatcttaggctgccgattttgtcgggagcttttttgctcgtaataaaccttggataagcagcatatgatggattgtcaaaaaatgaaagcgttttaaaagagaggagaacaaatgaatatgagaaagtgtttcatccaagtccttgcattgcttttcatcattgctgcatgtttcgcgccaaaccaagcctctgcacaaactcaaaaacctgttttttcagaagtgacggtacatgatccatcgattattaaagcgaatggcacgtactatgtcttcggctcccatttagcttcggccaaatcgacggacctgatgaattggacgcaaatttcctcgagtgtccacgacggcaatcctctgattccgaacgtctatgaagaattaaaagaaacctttgaatgggctgaatctgatacgttgtgggcacctgatgtcacccagcttgaggacggcaagttttatatgtattacaacgcctgccgcggggattctccgagatccgccctcgggcttgctgtcgcagacgacattgaaggtccatacaaaaataaaggcatttttctgaagtcgggaatggatgggatcagcaatgacgggacgccttatgacgcgacaaagcacccaaatgtcgtcgatccccacacattctttgatcaaaacggaaagctgtggatggtgtacggctcctattccggcggaatttttattttagaaatggacaagaaaaccggatttccgcttccgggacagggatacggcaaaaagctgatcggcggcaaccacagccgtattgaaggcgcatatattctctaccatcctgaaacacagtattactacctgtacatgtccttcggggggcttgccgctgacgggggttacaacattcgcgtcgcccgctccaaaaaccctgacgggccttattatgatgcagaaggccacgcgatgattgacgtccgcggcaaagaaggaacgctttttgacgatcgttcaatcgaaccgtacggcgtcaaactgatgggaaatttctcatttaacaataaaaacggctatgtgtcgccgggccataactctgccttttacgatgaaaaaagcggtaaatcatatttaatcttccacacccgcttcccgggacggggcgaggagcacgaagtccgcgtccaccaattgctgatgaacaaacaaggctggccggttgtcgcccctcaccgctatgccggagagaagcttgaaaaggtgaaaaagtcagatgtgattggcgattacgaattggtgaggcacggcaaagacatctccgcagatattaaagaatcgaaagaaatccgcttgaatcaaaatggcaaaataacaggcgcagtagccggaacgtggaagaacacggggcataacaaaatagaactcaagatcgacggaaaaacctacgatggcgtgtttttgcgtcagtgggatgcggcttctgagcgtaaggtgatgacgtttagtgcgttgtctcgtgagggagatgcggtttgggggagtagtttaaaaagagcggaattttaaaaggaatttcatctctaaaagcacattcctgattaaaggtatgtgctttttaaatgatttagatcaaatggttgttttaatatggaaattcaggatggattatacgataatacatatatggtcttttttactacataagttgttcgtgagattctatgaagaaaaatcaacaaggggtgttgataaaatgggttttaaaaggagttttaaaataatgcctggtgtcaaacttaatataaataaaaaaagtgttgggatgactttagggggcaaaaatggcaggataacttataatacttctggcaaagtaacaacaagtgcaaaaatccccggtacaggtctatcttatagttccagtaaatctatttcttcatcacaaaaaca

SEQ ID NO: 98 - protein, 475 aa, Bacillus licheniformis
MNMRKCFIQVLALLFIIAACFAPNQASAQTQKPVFSEVTVHDPSIIKANGTYYVFGSHLASAKSTDLMNWTQISSSVHDGNPLIPNVYEELKETFEWAESDTLWAPDVTQLEDGKFYMYYNACRGDSPRSALGLAVADDIEGPYKNKGIFLKSGMDGISNDGTPYDATKHPNVVDPHTFFDQNGKLWMVYGSYSGGIFILEMDKKTGFPLPGQGYGKKLIGGNHSRIEGAYILYHPETQYYYLYMSFGGLAADGGYNIRVARSKNPDGPYYDAEGHAMIDVRGKEGTLFDDRSIEPYGVKLMGNFSFNNKNGYVSPGHNSAFYDEKSGKSYLIFHTRFPGRGEEHEVRVHQLLMNKQGWPVVAPHRYAGEKLEKVKKSDVIGDYELVRHGKDISADIKESKEIRLNQNGKITGAVAGTWKNTGHNKIELKIDGKTYDGVFLRQWDAASERKVMTFSALSREGDAVWGSSLKRAEF

SEQ ID NO: 99 - DNA, 1828 bp, Bacillus licheniformis
  CDS (501)..(1325)
acgcatgatcaatggcgcgccttgcaaaagggctggacgatgaaacaggtggagctcaagctgccgcgcttctcatttcaaacagactacatgttaaatgaaccgcttaaacgccttggaatgaaaaacgtgtttagcagcgcgaatttttcaaatatgtttaccgggcatggcgccgctcaaattaataaagtcagacataaaacatttatcaaagtggatgaagcgggcactgaagcatccgcggcaacggcggttgaaatcatcgaatcagcccccgtccctgaagtgaccatgactgcagaccacccgttttattttgcgatcgttgatgaagcatccggaatgattctctttttgggcagtgtggcagagccgaaagatgattaaatctggggaaataccattattttataaaaattcattaaacttcctgttttattaccgatattaggaagggagttcctttatggtgatgaataaacaggaggcaaggacaaatgaaaaaaagtttgtttctgttcgtgttcagtttgtttttgatggcgattccagcattttcggcttcggcgaatgtttacgaagatgagtatgaacccaacaattctttcgctgaggcttacgatgtagggttgtggaaatacaagacgatttcggcgacgattcacagcgaaagcgataaagattattacaaattttacgcgacaaagggagaacagcttgccattcacctaaagaacatcccggcaaatacagattatgatctatatttatttaaagatgcttacggctatcccgcagtaggatcttctgaaagaatgggaaaccaaaatgaaatcatccgcttggatgttcccgagacaggccgatacattgcggtcgtcatgtctaaagacggttcatatgacggctggggattttacagacttgaatttatcgacagaatgaagagcggtgcttatacggcgaatttgtctccgtcatccatctcaagcccgggacagggagtcgtttctccggttgccgccgtcaatcttgccaatgcctcggccattcccgaaggagcgactgtgaaaagcgtttctgccgagggaacgatatatccaagtctcggacacacctacagagaagtcctgaacaaggaagaaggcgtttggcacacatcggtttcaggcggcacactgtttccggatctaaagcctgaacttgcgcttcccgtcaaaacgacatggaatgtgagatactattcgctcgcttggagcagttcaacttggagatcgccgcagctgaagatcaattatcaatacgattcaacatacggctggtaaacagatccaaatcccggccgatataaaaagtaatagaatgtaattggcatgaaaggagctcccatgaatattagagacagggtaaaactttcgctttattccgagcagctgatgaagccggccgccgcgaatgtgccggcaaagactaaaggctccaaaaggatgcccgccagccaaacagacactctctccatcagcaaacaggctgaatcagcccaaaaaaatgcaccgtcattacggtcacaaatgaacggcgttcaatttgagatctataatctttatgtggacaggcagcgtttgaacagccagatcgaaggggcgctgcgggagagcggaatttccctttccgaaagcgaacatctgacattgcatgttgacggacataaccggattacagttgaaggcatcgaagacgaacaaaaaagaacccgtatcgaagctgttttaaacgacagcgataaacggttcggtgcgcgtctgttgggccacgcagaactgat

SEQ ID NO: 100 - protein, 275 aa, Bacillus licheniformis
MKKSLFLFVFSLFLMAIPAFSASANVYEDEYEPNNSFAEAYDVGLWKYKTISATIHSESDKDYYKFYATKGEQLAIHLKNIPANTDYDLYLFKDAYGYPAVGSSERMGNQNEIIRLDVPETGRYIAVVMSKDGSYDGWGFYRLEFIDRMKSGAYTANLSPSSISSPGQGVVSPVAAVNLANASAIPEGATVKSVSAEGTIYPSLGHTYREVLNKEEGVWHTSVSGGTLFPDLKPELALPVKTTWNVRYYSLAWSSSTWRSPQLKINYQYDSTYGW

SEQ ID NO: 101 - DNA, 2584 bp, Bacillus licheniformis
  CDS (510)..(2081)
gcttaattgctcgcatgttatgccgggcttttcagcgggaaacctttcggagtgttcattcggtcaagataccgtgcagaccgctttcagcccagggcggttcctctcttttcacgtactcttgcctactattctccatcttcagttcagctcatatgtacactaatttatattataatacgagtgttacgtttgcatgtcaaccctatttgcggttctttttattctgaattgattctttggacgtcagccccagctcagtggccgtttcttccatgaagccggcgcgctccgggtccgcatgctcctttagatgcagattcgcatcttgctcatggatcgccctgcccattctttgattatacctcatgcagcaacatccttttgatatcttttttctatagtataaacaaatcattttcattttattaaaaaaacggcaaggaatatacgatatagaagaagaagtagtgttccaagttttttaccgaaaggaggagatgggaatcaatatgaaaaaaagagcggtattgatcctatcgatgatgctggcagcacaagcagccttttatacatcgtcaaacacagcttctgcagccatcggggaagccgtgattgccaccgatgaaatcaatgtcagaagcgggcctggactgagccacgaaatcgtcagcgtcgtcagcaggaatgaaagctatccgattcttgaagaacgcggggattgggtgcaaatccagctgaacggcgggcaaaaaggctgggtcgtatcctggctgatcaagaaaaagagccaagtctccagcggatctgattccgcatcgggaaaagtcacatcttccgaagcaaacttgagaatcagaaaaggccccggcacttcatatgaagtccaaggcgtattccctgaaggagaacaggctgacctgctaaagaccgacggaaaatggataaagatttcctatcagaacatcacaggctgggtctattcagattatgtcaatcaaggttcaggcgcgaaacagtctcaatcgtcttcatcacatgcttcatcatcaaaatcgggaacggtcggcgtatccaccttaaatgtcaggagcacagcttcccatcaaggccggattattgccacgctccaacggaatgcaagtgtgacgattttaaacgaacagcacggctggtatgaaatcgaatttaatggacaaaaaggctgggccgcaagccactatattctcgaaggaaacaaacagaacagcggaacctccggaacaagcagcagctccgaagcaaaacggcagggcaccatcgtgtatgaaagcacaaatgttagaagcggggcctcgacatcctcagcgatcgtcaaacgcacgggaaaaggcgagtcttacccgatcgtctctacaaaaggagactggtatgaaatcaaactgtcaaacggcgattccgcttatgtcgcaagctgggtcgttcagactgttgaccaggcaggctcagccggagattcgaaaagcgcagcaccgcctttggcaaagcggtcaagctcgggaggcacaatcaaaaataaaacggttgtcatcgatgccggacatggaggacatgacagcgggacaatcggaacgcgggggacgctcgaaaaacggctgaccatcaaaacggcaacgcttcttgccgcgaaactgagagccgatggcgtcaacgtctatatgacgcggaatgacgattctttcgtcagccttcagtcgcgggtcgcgacctctcattaccgaaacgccgacgcttttatcagcattcattatgatagctttccaaatgcgtccgtcaggggaaatacggcctattactacagcccgtccaaagaccggaagctcgcagcagacgtgcagtccgagatcgaaaggcactcgcctctgccaagccgcggcgtactattcggggactacttcgtattaagagaaaataaacagcccgccgcattgtttgaactcggctacttgagccatcctcaagaagaagcggtagtcagcacgaacgcttacagagaaagagtgacagacggcatcagaagcggtctagaaaactattttgactaatttaaaaagctcccaatcgggagctttttatgctttcgaatccataataaacgtgacgggacccgaatttgtcagcttgacatccatcatttctccaaatcttcccgtttcgacagtgacgccttttgcgcgaagcatgctgttccactcttcgtacaattgaagcgcctgatcgggctttgccgcttttgtaaaattcggccgtcttccttttttcgtgtcgccgtacaaggtaaactgagaaaccgataaaacggagcccccgacatctaaaagcgacaggttcatcttttcgccttcatcctcaaaaattcgcagattgacaagcttctccgccaaatatgcggcatcctcgctcgtatcttcgtgcgtcacgccgacaagcaccatcaagccgaggccgatttcgccgacagtctcgcctcctaccgaaacgcttgcatctgtgacgcgctgaacaactaatctcatgacgcttttcctcctaattcatcaccctg

SEQ ID NO: 102 - protein, 524 aa, Bacillus licheniformis
NMKKRAVLILSMMLAAQAAFYTSSNTASAAIGEAVIATDEINVRSGPGLSHEIVSVVSRNESYPILEERGDWVQIQLNGGQKGWVVSWLIKKKSQVSSGSDSASGKVTSSEANLRIRKGPGTSYEVQGVFPEGEQADLLKTDGKWIKISYQNITGWVYSDYVNQGSGAKQSQSSSSHASSSKSGTVGVSTLNVRSTASHQGRIIATLQRNASVTILNEQHGWYEIEFNGQKGWAASHYILEGNKQNSGTSGTSSSSEAKRQGTIVYESTNVRSGASTSSAIVKRTGKGESYPIVSTKGDWYEIKLSNGDSAYVASWVVQTVDQAGSAGDSKSAAPPLAKRSSSGGTIKNKTVVIDAGHGGHDSGTIGTRGTLEKRLTIKTATLLAAKLRADGVNVYMTRNDDSFVSLQSRVATSHYRNADAFISIHYDSFPNASVRGNTAYYYSPSKDRKLAADVQSEIERHSPLPSRGVLFGDYFVLRENKQPAALFELGYLSHPQEEAVVSTNAYRERVTDGIRSGLENYFD

SEQ ID NO: 103 - DNA, 1774 bp, Bacillus licheniformis
  CDS (516)..(1271)
gtgccgctgctgttgaaaaacgaagcttttttaaaggacattttcccggatatgccggaagaggatctggcgcaattgaaagacgatctggcgattgaaatcagaacggattcacttttcaacttaagctacacagggcctgataaacaggaaacattggatactttaggaaaaattaaagatgcctatatgaaaggcgataaggcgctgttctcaaaaagagaagaagtcattgaaaagaatattaaggcgcttgaagacgaaacagtcagcgctgattccaaagttgacaaacagcggtttttgtatgagcttgaaacaagcaagcttgatatgaaggctgctgaagaaattgagccgttgatcgtgcttgataaccaggctgccggcatgtcgcctaagaaaagagcggtgctgggcgtactgatcggtttagcgctgtcatttttcatcattgtcattccggaagttttcagagaacgttaaatttttaattggggatgtggatcaggaccatgacgaggcaaaaacctttaatctctgtcattacgccttcctataacgcggaggaatttatcgaaaaaaccattaagtccgtcttaaatcagacgttttccgactgggaaatgatcattgccgatgattgctcaacagatgggacaagagacattttgaagcgctatgaagaagatgatgagcggatccatgccatttttctgaaagagaatcaaggtgctgcagcggcgcgaaatgcggcgctcagcaaagccgaagggcgctatgtcgcctttttggacagcgatgatgtttggaaagcagaaaagctggataagcagctcgccttcatgagaaagcatcagcatgctttctcatttacggcatacgagctgatcagccaagacggcgaaccgcttcataaaaccattcatgcacccgtaagccttacatatgatgatgtattaaaaaatacgatcatcggctgcttgacggtgatgattgacagagaacaaacgggtgatatccggatgccgaatattagaacccgccaggatttggcgacatggctgtccgtattaaagcgggggttcaaggcatatggactgaacgaacccctcgcggaataccgcatcgttgaaacatcgatctccagaaacaagtggaaggcggcgcgaaaaacctggtacgtatacagggaaatcgaacgacttcacttgatgaaagcgacatggtgctttttccattacgctaagaacgcagtaatgaaaagattataacggcattgacagaaaaggtgattgaaagtgaaagcagatcaattcatacacgtcatagtagcgacaggtgaatgggggcaggatcagctaagatacagaaggcaccgccttgctgagtttttagcaggccgcaaggagacgaaggaagtcatttgggtttgtccgtctgaaaatccttcccgtgagacttttacattgcttgacaacggaatcaagcaatttgcagtcaaagattttttgaaaaagaaaatattcaggtttgcccgctacaaagatgttttctatcaaagcaagctgaagccgctgcttgaccggctgaaagaagacgttcagggagaaaaggtgtgcttatggtacaccttccccggctttccgctgctgtcgtcgctttatcaatgggatcaggtcatctatgactgcagcgacctgtgggcggccccgatcagcggtagccaaagccttgtctcaggattcaggcaaaaggtcatttttgaagctga

SEQ ID NO: 104 - protein, 252 aa, Bacillus licheniformis
MTRQKPLISVITPSYNAEEFIEKTIKSVLNQTFSDWEMIIADDCSTDGTRDILKRYEEDDERIHAIFLKENQGAAAARNAALSKAEGRYVAFLDSDDVWKAEKLDKQLAFMRKHQHAFSFTAYELISQDGEPLHKTIHAPVSLTYDDVLKNTIIGCLTVMIDREQTGDIRMPNIRTRQDLATWLSVLKRGFKAYGLNEPLAEYRIVETSISRNKWKAARKTWYVYREIERLHLMKATWCFFHYAKNAVMKRL

SEQ ID NO: 105 - DNA, 1309 bp, Bacillus licheniformis
  CDS (485)..(808)
tgatgaagcggtgaaccgctttaaagatataccgaaagagcgccgcgtccttgtgacaagcgaaggggcttttaaatatttcgcttcggcctacggcgtcgacgcgcagtatatttgggaaatcaacaccgaaaatgaaggaactcccggtcagatgaaaaaaatcgtcgacacagtgaagaaaaaggacgtcccggccttattcgtggagacaagcgttgacccgcggagcatggaaagcctttcagccgaaacgggcgtgccgattaaagcaaaagtcttcaccgattcgatcggaaagcccgggtgaagcgggagattcctattataagatgatgaaagaaaaccttgaccggatccatcaaggcctcgccgaataaccaatgaactgctgtacaggatgtacagcagtttttttcttatgtttttccgattttaaagcagggtacaacgaagggaaaacgaggaaaaaggagtgtgtttcgtgaaatctggatatgaggaatgcatcaaagcctgccgagaatgtcttgaagcctgcaaccactgctttgacaaatgtctgatggaagaagaggctgggatgatggccgaatgcatccgtcttgaccgggaatgcgcggagatgtgcggttacgcaattcaagccatgacgcgcaacagcccgtatgccgaagatatttgccagctttgcgcaaaggtttgcgaagcttgcggcaatgaatgcagccagcacaagcatgaccactgccaattttgcgctgaaagctgctttgcatgcgcggaagcgtgcagaaaaatggcttcttaacttgaaacatccggccctcgagccggatatttttatgtaggaaatgtttattttttctccttccccctttctaaactgatacaatatgactataaaagggggttttatcatgaaagacagcgtgtttcaaatgacttctgacacatatcaatctctcagcgattcagaacggcatttgctcgagtacatttatcagcacttagacgtcatcgccactttatcgattgtaaaattaagcgaggatgcaaatgtttcaacagccacgattgtcaggttaatgaaaaaactcggatatgacggctacacttcttttaagtatgcattaaaagaaaaacaccacctcggacacgctccgctgatggatgatatcgacagccaaattaaacaggccgtgctaaagaatgaaagagaagttctggatacgattaagatgcttgatatcgggttgatcgaagatgccattcaaaaaatcagcaatgccgaaaaagtttacatctt

SEQ ID NO: 106 - protein, 108 aa, Bacillus licheniformis
VKSGYEECIKACRECLEACNHCFDKCLMEEEAGMMAECIRLDRECAEMCGYAIQAMTRNSPYAEDICQLCAKVCEACGNECSQHKHDHCQFCAESCFACAEACRKMAS

SEQ ID NO: 107 - DNA, 1561 bp, Bacillus licheniformis
  CDS (284)..(1060)
gatatgagcgacacagaagcgcttggacatgcgatcagcgccgcctttgtcgccacccttctcgggatcttcaccggatatgtactatggcatccttttgccaataaattaaagcggaaatccaaacaggaagtcaaagtccgcgaagttatgattgaaggcatcctttcgatcttggaaggccaggctccaaaagtcattgaacaaaagcttttgatgtacgtttctccaagcgaacgctccagcatcgtcatcccagatggagacaaaggggacagcagcaatggctagaaaaaagaagcacaaaaaagaccatgaagaacacgtggatgagtcttggctcatcccatatgcagacttgctgacactgcttttggccctgttcatcgtactgtttgccatgagctcgatcgacgccaagaagttcgatatgctgtcaaaatcatttaatgccgtatttaccggcggaacaggaatgatggattattccagcttcaccgagccgaaaacgagcacaaccgaagatggaaaaagccctgaccaggcaaaagatctctccgaagctcaaaaagaaaaagacaagcagtcgctgaaaaaaattcaggagcaggtcaaccggtttattaaagagaagaatcttcaaaaacaggtcaatacgaagctgacagacgagggcctcctcctttccatcgaggataatatctttttcgattccggaaaagcggagatccgccagcaggacattccgctggccaaggaagtatccgaccttctcgtattgaacccgccccgcaatatcgtaatcagcgggcatacggacaatgtgccgattcgaaattctcaatttaaatcaaattggcatttaagcgtgatgcgggctgtcaatttcatggggcttttaatcgaaaatccaaagcttgacgccaagatcttcagcgcgaaaggctacggggaatttaaaccgatcgcttcaaatgacaccgaagaaggaagaagaaaaaacagacgcgttgaaatccttatcctgccgatcggccaggaaaatctgaataaaaaagaataaggaagctgtcttttggcagcttccttactctttgcccttataaatatttcttgcattcagtccgacttttttcagcatttcgatgcaggcttctttctcctcatcgcttaatacgctgatcatgttgtgcagctcttctgcatgacccggaaaaatcttctcgaggagctcggtgcctttatctgtaatttgcgcataggtcaccctgcggtctgtcgtacaggctcttctcgtgatcagctgcttttgctcaagcttgtcaaccacatatgtaatactcccgctcgccagaagaatcttatcccctatttgctgaaggggctgatcccctttatgatagaggagttctaaaacggcaaactcggttggattcagaccatgatgatgaatatgtttattcatatgatcattaatggatctgtacgctcgagataatacaataaataacttcaaggactgttcctgttctctattactcatatcactcatctccaaaga

SEQ ID NO: 108 - protein, 259 aa, Bacillus licheniformis
MARKKKHKKDHEEHVDESWLIPYADLLTLLLALFIVLFAMSSIDAKKFDMLSKSFNAVFTGGTGMMDYSSFTEPKTSTTEDGKSPDQAKDLSEAQKEKDKQSLKKIQEQVNRFIKEKNLQKQVNTKLTDEGLLLSIEDNIFFDSGKAEIRQQDIPLAKEVSDLLVLNPPRNIVISGHTDNVPIRNSQFKSNWHLSVMRAVNFMGLLIENPKLDAKIFSAKGYGEFKPIASNDTEEGRRKNRRVEILILPIGQENLNKKE

SEQ ID NO: 109 - DNA, 1735 bp, Bacillus licheniformis
  CDS (501)..(1232)
gaaaggcatgataactatgaatattcaacaaattcgaaatgcaacattggccgtcaaatatgcgggcaaaacatttttaatagatccgatgctggctgaaaaaggcgcttaccctcctttcccgaactcagcaagacaagagcaaaacaaccctttggtcagcctgcctgtgccaaccgacgagctcgtcaagaatacagacgcagtcatcgtcactcattcggacccggatttctctcctataaactagaagcctcatgttgaaaaagtattttatattgaaaaagaattctatctgggacctcgccgggagcaggaaagaggatcactgaaacatcaatgaattatattgttaaaaatcagaattttatataaaatcaaactttatcagtaaaaaaactgtaacgaaattcgcatcaatctgtcatagcggtgacattttgctgtgttacgattttccctgttagtttcaaaagggctaacaagggaggatttaacttatgaagaagacaatcatgtccttggctgcagccgcggctatgtcggcgactgcattcggagcgactgcctcagcaaaagaaatcgaagttcaaaaaggagacacgctctgggggatttctcaaaactacggaatgaacctcaaggacttaaaaaaatggaatcagctttcatcagatctgatttttccaggtcaaaagctgaacatttcttctcaagaagaaaaatctgaagaaaagcagtacaccgttcagccaggggacacgctctcaaaaatcgcaaaagagttcggtgtgactgtaagcgatcttcaaaaacggaacaacctgaagtcagacttgattattgcagggcaaacgattgcaataaacggagaagcggcagctgcagcagcgcctgtgaaacaagagtccgctccaaaacaaaatgatcagcctgtcaacgtacaaaaggaaatcacagtgaccgcaactgcgtatacggcaaatgacgggggcatttcaggcatcacaaaaacgggagtcgacctgaatgcgaaccgcaatgcgaaagtcatcgcggttgatccaagcgtgattccgctcggcacgaaagtatatgtggaaggctatggcgaagcgacggctgaagacaccggcggcgccattaaaggccataaaatagacgtatttattccagataaaaaagacgctttcaattggggcgtcaaaaccgtaaaggttaaaattttaaactgatataaaaaatgcaggaggcgttaattgcctcctgcatttttttgtcgaacgatgtttatgctgcatgctgttccgcgcgtctgctttttacaaaaaccgaaatcgcaagagcggcggctgcaaaggcgatggctacgaaataaaccatatgaacgccttctgtcatgccttgcatgtgcagctcctgacggctgcctccggaagagtgcgcgataaagcgattcgaaacggttgtcaggatcgtcgtatacaatgccggaccgattgcccctgaaacttgattaactgtattcattatcgccgaaccatgcgggtaaagcggtttgggcacctgattcaaaccgagcgtcataatcggagccattgtcaacccgacgccgagtgtaaagccggcgtagagcatcattccgaccgccatcggcgtatcgcttgaaatattcgtaaacagcgaaaggacggcaatcacaatgatcaatccggtgatcaacagcggtttaaag

SEQ ID NO: 110 - protein, 244 aa, Bacillus licheniformis
MKKTIMSLAAAAAMSATAFGATASAKEIEVQKGDTLWGISQNYGMNLKDLKKWNQLSSDLIFPGQKLNISSQEEKSEEKQYTVQPGDTLSKIAKEFGVTVSDLQKRNNLKSDLIIAGQTIAINGEAAAAAAPVKQESAPKQNDQPVNVQKEITVTATAYTANDGGISGITKTGVDLNANRNAKVIAVDPSVIPLGTKVYVEGYGEATAEDTGGAIKGHKIDVFIPDKKDAFNWGVKTVKVKILN

SEQ ID NO: 111 - DNA, 1731 bp, Bacillus licheniformis
  CDS (507)..(1274)
aaatatgcatattttgtgttgttcgtcattgcggcgctcattacgcagcctgagttattgtcgcatttaatggtctccgtgccattgctcattctttatgaaatcagtatcgtgatttcaagaatatcctacaggcaagcgcaaaaaacaatgattcaagaggaaatcaatcgtttggaacgaccatacaaaataagagcattcttttttaagcaacgtctttggtttcttcggccgcttttgcatcagccccgctggacgtttaaaagaaagaagaaaagccggaaggggatatcataagctgagatgcgagattattcagaaaagcccggatgtatggccccagctggaagagtgaaatcaaggggaacggtttttaagatcatggaccagcagtatgccattatcttattttcgaaagcaaataaaagacgttttctgtttaaagaaaacgtctttttgcatcaagccgtcttatcataacaaaaacagattggagaatgcacatgatctcgtggctcagtctggcttcggccgctttcatcggccttgctgctttagtgtggagaatgtcagccatcgcgcgcgaaaaccgggtgttgaaggctgaattttcactcgggcgcctgaaaaaggaattgaatgtcttttttatttcagatattcataggcggacagtcagcgaagacattatttgtgaagtgaaagaacgcggggttcagctcgtcatcatcggcggcgacttagcagagggcggcgtcccttatacgagaattgaagaaaatatcaaaaggctttcaagtttgggaaaaacgtattttgtatggggaaataacgattatgaagttgatcaggaaaggctgctggaaatattcaagacatacggtgtaacgcctttgcgcaatgcttcggtattgcatgaccatcaaggacaaactgtcaatatttgcggagtggatgacatcagactcgaattggatgattacccggcagctctcggcggcgtgcagccgggttttccgactgtccttgtgtcacataatccggagattcatcatcaaatacaggaggcggacggtattgacctgatattgagcggtcatacccacggaggacagattcgcttcggcagattcgggctctgtgaaatcggaggaaccggcactgttttcaaggctccgtacttgatcagcaacggctatggaacgtcgaagcttcctgcggggatcctaggcgtgcccgcgatcgccatggcttatgtcggagaggaatttgatccgcgagggctcggcaaaatgatggggctatacattagcggcacaagcctcggaggaatgagcggaaggcttttgaccggccttttgacagacttgttcagctggcgcgcggcgctaggaatcatcggggcattatcagtactattaagctatttgttttggattttgctgccccggccgcagcactccgctaagcgaaaaacaagtgtgaaaaaagcgagcttggcctacggcgccgtcttgatgaacaaacggctgctgtcaatcatttcacttggatttctattaatgggaagctttgttacgctgttcaattatatcgggtttcagttgatgggacctccgtacagactctctcaaactgtcatcgggttcatctttatcgtttatttggcggggacgctcagttctgtctatatggggaagaaagccgatcgttttggcagcccgttga

SEQ ID NO: 112 - protein, 256 aa, Bacillus licheniformis
MISWLSLASAAFIGLAALVWRMSAIARENRVLKAEFSLGRLKKELNVFFISDIHRRTVSEDIICEVKERGVQLVIIGGDLAEGGVPYTRIEENIKRLSSLGKTYFVWGNNDYEVDQERLLEIFKTYGVTPLRNASVLHDHQGQTVNICGVDDIRLELDDYPAALGGVQPGFPTVLVSHNPEIHHQIQEADGIDLILSGHTHGGQIRFGRFGLCEIGGTGTVFKAPYLISNGYGTSKLPAGILGVPAIAMAYVGEEF

SEQ ID NO: 113 - DNA, 1722 bp, Bacillus licheniformis
  CDS (540)..(788)
caggcgtttgcttcagtacatcggttgattgtgtcatgcttcatccctctttctttatagacataaaaaagctcttcccgataaggaagagcttgatatattcaatctcctccttatcttcaagagcacgaacatgctcttaaggatttagcaccattctgtcatagacagcggttgccgggtttcacagggccagtccctccaccactcttgataaggaaaacctttttatgcgattttttaatagttttaatattaatactttttataaaaatgtcaatgggtttaaaaaaactcttcgtttttttcattttcttcttctgcggttaaactggagggcgtatcgaatcaatgtgtgaatttttcgtcaggacagccgttcaaacagtcaacaagatgctgaacaaacagaataaattagaatttttttcaatttttatttccaaaaacagaaactttttattgagttcaccggtctataatgtgtacctgatttcaaaatgggtattataaaaaatgacagattaaggagggtttttatgaacaaaaaaacagtgtttaaagcgttcggaatgttgatgacaggggtattgttttttgcgctgtacagtgcggccgcacttccttctgcacacgcggcaaacgaaaaaaaaccgacggtcacgagccatacgtacaaaaacattaaggctttgaaatacccgcaagtttcaaatgtaagccccaaatctctccaaaacaagatcaacaaagattttaaacattatattgagcagtcctacaaagattagtaaaaaacaagaaagacggccaacagcacggataccaaacggattatcaaacgtcctttgaagtgaaataccggaccggccaaaagctgagcatcctgacaagcaattacgtctattccggcggagcgcacggaaatacggcagtccgctctttcaactatgaccttgtctctaaaaaacgggtgtatttatccgacatcctaaatacaaaatcgaaaatggataagacaaaaacatacatttacaactatattcaaaaacacagcgacattttctttccggatgtgaagaagaaagacatcgtcctcggtaaaaacacggccttctattacactaacgacggcattgcgatcgtcttccaacaatacgatgtcgccccttatgccgccggaaatccggtcgttgcagttccgaaaacggtgtatcaataaataacaaccgggggcttagtccttgtgcatcgcctgtgacccgaacccgaaaaaacggaagaagagctgaatctgatcgtcgactttggcgtaacggtgaaagatgtaacgattgaacatccggtctacggagacttaacagcttcgatcagggtcagcacaagaaaagaagtcgcggatttcgtcaaaaaaatctcttcgacaaacgccgcttatctgtctcagctgacaaacggcatccatctccacacattggaggcagatgatgaagagaagatcgaacaagcttgcggcgccctgcaaaaagcgggcatcctcattcccgaataaaagaaaaggtcctttgccgttatcagcgcaaaggacctttcttttatagtgtatatgcgttgtaggcaccgagcattttcaccttgcagcccaaagcttcaagctcagctattgcacctggaatcagcacgtcatccagggccatttcaatatcaataatgaagaaataa

SEQ ID NO: 114 - protein, 83 aa, Bacillus licheniformis
MNKKTVFKAFGMLMTGVLFFALYSAAALPSAHAANEKKPTVTSHTYKNIKALKYPQVSNVSPKSLQNKINKDFKHYIEQSYKD

SEQ ID NO: 115 - DNA, 1705 bp, Bacillus licheniformis
  CDS (507)..(1202)
cagatgaatctgatccgattgatatttttgaaacgacaagccatgtatttgttaaaataccgctcaccaaagaacagcttaaccttctgaaaattaaacatacttcacaaaccctgatcatagaaaactaccctgaaaaagggcggcaggaaaaagtcgttctcccctctctagtgcgcagaaagggtacgaaagcaatatttaaagacggcattttggaagtgatgttcttaaaaaatgaggactttaacctgtctgaaatcgacatcacgttttgaaaacggccagcttgaaaaagcaggctgttttttttcttcctgtatcatcttaacactactcctcaaggatgatcatctcatttgcctgacattcggccgcgcctttaaattttgacagtgttagtcattattccttaaaaagtctctgtaactatttcctctttcggctgttgtcgatttgtccttataatgataatggttctcaatttataaaacaggaggatgtatatgaaaaagaaaatcagcatattgatcacagcaatgtttttgacaatcctttgtttttcgcctcaagcttccgctgcgtacaactcactgcatacgggctatgccacttatacggggtcgggctactccggcggcgcattgcttttggaccctattccgtccaatatgaagatcaccgctttaaatccgacagatatgaattaccgcggtgtgaaagctgctcttgccggcgcctatctgcgggttgaagggccgaaaggaaaaacgaccgtctatgttaccgatctgtatcctgaaggagcgccgggagcccttgacctttcaccgaacgcttttcgcgagatcggcgatatgaaagacggcaaaatcgacattaaatggcgtatagtcaaagcgccgattaccggcaatttcacttaccggatcaaagaaggcagcagccaatggtgggcggcgatccaagtcagaaaccacaaatatcccgtcatgaaaatggaatattacaaagacggaaagtggatcaacatggagaaaacggattacaaccatttcgtcagcaccaatctcgggacaagtccgcttaaagtcaggatcacagatatccgaggaaaagtcgtcaaagacacgataaaaaagcttccggaaaacgggacgtcaagcgcatataccgtaccgggaaaagtacagttccctgactgatcgatccggaaagaatgagacggcggccaaaggcgaaaagattcgcaggctttggccgccgcttcatattgacatccggcatttagacgccagcaacaattggcttattgatcaatagcccggtcctgctcctctgtatggagctgcgcccggaacacctccgtacggaaaagccccaggagctgccccgtagccgtaataaggcgcgccgccgtaaggtcccgggtatggcggcgggtaagcgtaaggtcttgggtagttaaaaatcgcgcttccgagaaatccgcccagcaatccgccgacaagcggcgctccaaaaccccagaataacgggaatctggccgggtatccggcaggacctgatctcgaataaagcatatgagggttcattggcttttatcctcctttatgtctgcctatagtaaaggtattcataaagtcgggaaacgtttgggctattcttcataaatcattttttttgtcattccgccgtccaccgt

SEQ ID NO: 116 - protein, 232 aa, Bacillus licheniformis
MKKKISILITAMFLTILCFSPQASAAYNSLHTGYATYTGSGYSGGALLLDPIPSNMKITALNPTDMNYRGVKAALAGAYLRVEGPKGKTTVYVTDLYPEGAPGALDLSPNAFREIGDMKDGKIDIKWRIVKAPITGNFTYRIKEGSSQWWAAIQVRNHKYPVMKMEYYKDGKWINMEKTDYNHFVSTNLGTSPLKVRITDIRGKVVKDTIKKLPENGTSSAYTVPGKVQFPD

SEQ ID NO: 117 - DNA, 1687 bp, Bacillus licheniformis
  CDS (501)..(1184)
gacgggaatcagattacagtcacgacaaggggatttggacatggagtgggaatgagccaatacggtgcgcattatatggcgaaagacggcaagaaagcataagacatcgtcaagtattattacaaaggaacagccgtatccaatgcagatgaatttttaaataaatacatggcgaaaaaataaaacaaaagacgtctgcctcttggcggcgtctttttgaatatcatcgaaatttggcattcccatgaatttgatgcacgctaaattattatacaaatatttctaaaaacatgtgccggagggcttgctgaacagcgtcaaaaggccgcaaacgccgtatcaacaataggggtcacaggttataaagtctattttatatacttgttgtatgatgaattgaataacgaggaaaaggagacatgccctatttatttctccctggtgttcttctacgataataatgtgttaacgactttatttcagaaaggggaaagggagaaatgaagaagaagatgacattgggcattttgaccgctatggttctcagtcttggttcgcctgcttttgcagctgagaaaaaacaggaggtaacagttgccgaagatgcgcccaacgttgcgattatgcttgatgcaagcggcagcatggctaaaaagatcggcggggtctcaaaatacgagcttgccaaaaatgaagcgttcagctttggttccaagcttgaaaatgcaaacgtgctcatgagagttttcggttcagagggaaacaataaaaattccggaaaagtgcagtcctgcaatgcaatcagaggggtgtacggcttccaaacgtatgacgagcaaagcttccgcaattccttaaacggcatcggaccgaccggatggacaccgatcgcaaacgcgctgcaagatgcaaaaaacgcgcttgaccagctggacaacaacgggaaaaacgtcgtctatctgctgacagacggtgaggaaacatgcggaggcaatccggtaaaagtcgcaacagaactgcgcaaatccaatgcggttgtcaacgtgatcggctttgattatgaaggagacttccacggacaattgaccagtatcgcagcagctggcggcggtgaatatttccaggcaaaaactaaaaatgacatcaaaagaatttttactcaggaagcaattgagctttctaaataaactggaaaaaagctgtggacatgtttccgcagctttccttttgtgatgaaaagattgtcaaaagtcaagaaaaatactttacaaatattaagttattgtgtcagagcgttgaaccctgctgcgtcctttggaggggttatttgtcgtaacggtagctttattgggatgaaatcggccttttagcagacttttttgataggtcttaagtgaatgcgtcgatcgattatcgtaaggattatgaagaatttgtgaatttgaaaaggagatccggcctatttatttctatcaagccttcttttacgatgttggtggacttgatctcatgcggaagatcggtccgaaaaaacaaatgcggaaaggaaagtgagaaagttgaaaaagaggtttgctctgttgacaacgttcaccatgcttttgtcattggcgccggcagcagcttttgcggctgaaaacggaaatgcggacaacagcaaaaaagatgtcaatgttgcagttgtgct

SEQ ID NO: 118 - protein, 228 aa, Bacillus licheniformis
MKKKMTLGILTAMVLSLGSPAFAAEKKQEVTVAEDAPNVAIMLDASGSMAKKIGGVSKYELAKNEAFSFGSKLENANVLMRVFGSEGNNKNSGKVQSCNAIRGVYGFQTYDEQSFRNSLNGIGPTGWTPIANALQDAKNALDQLDNNGKNVVYLLTDGEETCGGNPVKVATELRKSNAVVNVIGFDYEGDFHGQLTSIAAAGGGEYFQAKTKNDIKRIFTQEAIELSK

SEQ ID NO: 119 - DNA, 1428 bp, Bacillus licheniformis
  CDS (501)..(944)
attcacgcaaggttcctatttgaaacccgcttctacgatgaacgaaaaaacggcgtcgtatccgccggaaggctgaacgaactgatggaagaagctcagaaagaagcgttttgcggtgcgcttggcgagtatcatccgtatttttgggcatcaaagcttcatttttatattacgtctgttccgttttacaattttccttatacgttcggctacttgttttcgcttggcatttacgcgcaagcgctgaaagagggtgcggcatttgaagaaaaatatattgctctcttaaaagatacagcctccatgtctgttgaagaactggccatgaagcatctcggcgccgatctgacgaagcgggatttctgggaagcggccattcagccggctgtccgagatgcagaagcatttttagcgatgacataaatgcttccgcttagattgaatgagtttccgcaaagtggacatagctaaggataatgtgcatagaggagatgaacgggatgaatcaatttcggatggccgttatcgctctcgtcctgatcctgatgaccggctgcggctccatagcggaagaacatgcggaaggcaaggaggccgttcccgataacgcccctgtttcagatgtgaaaagcgtgccttacgctgcatttgcattggaagtgaactatggccatggaaagcacaatacgtttgaagccgtatacgacaaacaggagcgggaagaagcatcgattaaagactatctgaacggagcggaccgcgaaggggaggaagctttaaacgaaatgaaaatggttttaagcgagctttcgatcgccaaatccgatccagagcaggacgtgatcagcaatgtgctcgaggccttcaatcttgacgaacaatatgaccggtttcagctgcgggtgaaatggcctgatggcacgtccagaatctataacggaaaataaacaaaagagcatttccaaactggaaatgctcttttttgcttaagattttaaaaagtatttttcgatgtcatcaaggaacagatacgctgcttttacgccgccggccgtcgtccagatcgcatcgtcgacttcatgggcgtttccggtttttacagcgttcaattttttccacagcggatcgcttgtccaatcgttttgccatgtttcagcttcttttttgctttcggcaggtttatatgtgaaatagaacaggacatctccgtccatatcagggatcgattctttattttccgtcataaaaacaaatttgtcgtcttgtttctcaaacagtttttcctgtttttccggatacttgaatccgagctgatccaggataattcccgggaaagaatctttatagtaaatccttgattggccggccataaatctgattaccgacacccgtttctttttctggtcgccgagcttgtcgcttaattcg

SEQ ID NO: 120 - protein, 148 aa, Bacillus licheniformis
MNQFRMAVIALVLILMTGCGSIAEEHAEGKEAVPDNAPVSDVKSVPYAAFALEVNYGHGKHNTFEAVYDKQEREEASIKDYLNGADREGEEALNEMKMVLSELSIAKSDPEQDVISNVLEAFNLDEQYDRFQLRVKWPDGTSRIYNGK

SEQ ID NO: 121 - DNA, 1589 bp, Bacillus licheniformis
  CDS (501)..(1109)
agactcgcatgagggtgaagttggttcaactatttttaaaaatgtaaatcaatatcctataccaaatttataaagtgacataggataaactatgtctctttagggaggtgaaacatatgagcggaggttacggacacggaagcggttttgctttaattgttgttctgttcattctcttaatcatcatcggcgccagctggttcggcggtggatatggaggctactaaaaagttcgttttaaaagtcagcaataacttatgaccttctccttattttacatgttctcctcctgcttaccgttgttgactccatcatgaaaggctcttttttaaaaaagagcctttttttaatgcaatacagataccgaacctctcctgctgctgaatgttaatagaaaattaatgtttttttcaaaaagagacatgattttcattctattaatgctattatttttccatcctattaataaataggaaaattaagagagggagtgttgttatatgtttaaaactaagttcaagaaaacaattgggattggactcgttgccgctgcctgtttgatttccgcgtcggcggcaagcgctgcgtcgcaaaatgaaagcgatgttaaagtgaaactggacgatcagcagcggaatcaatatacggtcaaatctttccactacttaaccgttgacggaaaaaatgtggattcgtcggctcaagccaacgccaaatccgtcagagatgtcaaagtaaccatggttctgcccaagcagaataagaacggcgatttgcttgcgtatggatttacgagcaaggttactttagaagcctttatcgcgaaagacaagcagaggcttgagaagcaattcaaaccttctgccagcggtccctgctgtaccgatttctatgaatataaaaataaaggcgggcagtatatttactggagagacggatttaaaaacttgccatccagctggaatgacagaatttcatcgttaagtacggcgtctccttcatcaagctattcaacgacgctgtgggagcatacttcaactcaaggatacggcaaaggcgttttgtttagacattccgattggtacggcactaattcgagctcggcaccctgataaattacttttttttgcgatgccggtgttgttgatcggttcatcatgaccgatacagctgatgacatggatggtagtcatattccccgggagccgtttaacatcagattctgccgcctgctttaaaaatgccttgagatctgtatccgctttttgttcgttcaggtgcaggagtttaacatacatatcatagatcagctgttttgtcagttcagacatagtcaatggacagtcccttctttttattttccggttaacaaaatattttaatagtttatttcaggatttgtcaatattatgataaggtgaaatcagataacaaatgtgttttgtttatcatgaaacaacaccaaaaaggagaatcgctgatgaatattgaaggaatagagatggaagttcgctgcacaggcgatgtatgttcagatgcccttgaatttttgagacgccataaccacgaaaaaacagccgaacattcga

SEQ ID NO: 122 - protein, 203 aa, Bacillus licheniformis
MFKTKFKKTIGIGLVAAACLISASAASAASQNESDVKVKLDDQQRNQYTVKSFHYLTVDGKNVDSSAQANAKSVRDVKVTMVLPKQNKNGDLLAYGFTSKVTLEAFIAKDKQRLEKQFKPSASGPCCTDFYEYKNKGGQYIYWRDGFKNLPSSWNDRISSLSTASPSSSYSTTLWEHTSTQGYGKGVLFRHSDWYGTNSSSAP

SEQ ID NO: 123 - DNA, 1522 bp, Bacillus licheniformis
  CDS (501)..(1019)
taaataaaataaatgaaagccgcaatgaaaaacggcagcgtcgttttggaagatccgagatacaggcctaaaagcgggccgaagacgacgccgaggttgatcgcggtatagcggagattaaagacgaaaaggcgcgtttcgggtttggatacgtctgaaagcagcgctcttgaagtcggttcaaacaaagcgcggcataatccgtttaaggcattcatgataaagaatgtccagacatgatcggcgagtgcaaaaccggcgaacacgaacgtccagccgaaaatcgagacgagcatgatggttttccggccgaacctgtctgataagtacccgccataaaagcttgccgcaattccgatcagagagctcgctgcaatgacagctcccgcaaagccggaagaggcgcctttcacttgtgtcaaataaattgctaaaaaagggatgactcatggcgtgttcctcatgcgccttaaggtaaggcaaaaaagaaggtgatattgatgtacagccgaagcaagttcaaaatcggtttattgcttattggaagtctgctggccgcgctcagctttcacctggaggccttggccgaaaagccggctaaagttcaaatccagcttgaaaaggtttatctggacggagacgttggaattgagaataaagtagaggccgctcgcacactggaagactttaaagctgcttataaagggtggcagctcatcgatcagaaaaaggggtttattctgtttcgcaaacaggtggacgacatttctcccctcagcaaaacaaacggttatatcggagtgactgaagatggcgtgatttcgacttttcacggtcgcccgggcatcttatcagaacccattcaatcgttttttcagattgatataaagcggctggaaagccggatggcggatgatctgcgcaaagggataccataccgcacgaaaaaggaatttgaacatgtcattgaagccgtaaaatcatccggaagccaacatcatgtagaagatatgaagacatgacgctgttatgtcttttttcagctgcagacagaagcttttttagcgaacatatgttaactttttcattctagctttgcctgttttgtgttacaatgaagagcagtcaaagaggtgaatgaacgttgatcgaattcgtaaaagggacgattgattatgtatcgccccaatatattgtcattgaaaacggcgggatcggctatcagatcttcacgccaaatccgtttatttataagaaaaacagcaaagaaacaatctatacataccattatgtaagagaagacacgaatgcgctgtacggcttttcgacaagggaagaaaaaatgctgtttacgaaaatgctgaatgttacggggatcggcccaaaaggagcgcttgcgatcctcgcttccggcgatccgggagcggtgattgaagcgatcgagaatgaggacgaagcatttctcgtcaaatttcccggcgtaggcaaaaaaacggcaaggcagatcatccttgacctgaaa

SEQ ID NO: 124 - protein, 173 aa, Bacillus licheniformis
MYSRSKFKIGLLLIGSLLAALSFHLEALAEKPAKVQIQLEKVYLDGDVGIENKVEAARTLEDFKAAYKGWQLIDQKKGFILFRKQVDDISPLSKTNGYIGVTEDGVISTFHGRPGILSEPIQSFFQIDIKRLESRMADDLRKGIPYRTKKEFEHVIEAVKSSGSQHHVEDMKT

SEQ ID NO: 125 - DNA, 1492 bp, Bacillus licheniformis
  CDS (501)..(989)
aagagtgatcaaacggattaaacaggcgatctttattacgctgttttacggcataccgtccgtcatggtgatgtatcactttgcagagccgctgacccatttatttttcgattcggtcaaggcgtcgttttaccttaaaatgttgtggccgtattttttattccacttttttgcgatgccttttcaggcctgtttaatcggaatggggttggccaaagatgctttttatcataacgtttgggccagtgtcttatcgtttttgatgatgtatgttctcgggtccatgcagactttgcagatgacggggatcattcttgcgatgaataccggtatgattttgctgacggcgctgcattatgtgacgatttgcaaggagctgggcgtcacgctttttttgacaaacaaatcccgatctccgagaattgaaagccgctgatggatcctcttcatagttttagcttttgcggggaagctaatattaaaaaagaaggggagttcccatgcgaagaatcagtctcatttacccgctcatcctgctgttttttaccgggttattcgtatttcagccgcaggcatctgcaaaacaagcttcgccggcagtcatgcagatgaacacggtcgaaggtcagcgcgtcgtcattcccgccgaaggccagaagacgatcgttcatttttggacgacctggtgcccgccatgccgtgaagagcttccgcgattccaatcctactatgaaagcaagcaatccggcgtcaagctcgtgaccgttaatttactgaatgccgaaaagaacgaacagaaggtaaaacagtttattaaagcaaacaagctgacatttccgatcgtttttgacaaaaagggtgagatgatgaaagcatataaagtcatgacaattcctacgacttttttctttaatgaaaaaggagagctggagaaaacgtttgtcggccccattactgtagaacagatgaaggaatgggcagggaaaagctgagccgggagttcagctttttttaaaatgtaaatgataattaatatcataaagaaattataataattattatttgaaaacgtaggatgtcgtgctataatgagaaatagaaaagggtgtgtccaatggacaagtagcagtcataccctttatataaataaaatacttaatgtttatgctgccgatgaggcggcaatttgttttttaagaaggaaattgacgatgaattacattctcaattagggaggatattggagatgcaattagagatcgggaagcaatcgcagcaaaaccgtcacacgttgcaatttgaaaattggaggcagcacggggaattgatagctgcgcttttgtcgggtttgttgattcttgcaggctggctgttgtccggcaatgaaacattgtccgttgttctgtttattttagctttttgtatcggcggctttgctaaagcgaaagaaggtatacaagaaacgctgtcggaaaaaacgctgaatgttgaa

SEQ ID NO: 126 - protein, 163 aa, Bacillus licheniformis
MRRISLIYPLILLFFTGLFVFQPQASAKQASPAVMQMNTVEGQRVVIPAEGQKTIVHFWTTWCPPCREELPRFQSYYESKQSGVKLVTVNLLNAEKNEQKVKQFIKANKLTFPIVFDKKGEMMKAYKVMTIPTTFFFNEKGELEKTFVGPITVEQMKEWAGKS

SEQ ID NO: 127 - DNA, 1477 bp, Bacillus licheniformis
  CDS (501)..(974)
gatgctccgcagtcctgctttagtgcgggaaatggaggatcacagcttaatgtacggactgcccgaagcggaagagcggctcagttttttgctgaatcaaagccggcctctgcaaacattcgacgatgcctttaaaaaaagaaagaaacaccttgatttaaccgaagacctctgcgacctgcttgaagctttccggagtctcaaccttgaagtgatcgtcgttgatcagacttcccctgttatcaaacggaatggactttattgtgtgaaagttctcatcccgggcctgattccgatgacattcggacagcgcttcatccgcctggaagggcttgagagaattttcaccgtgccgaagaagctcggctttgcggaagagccgttaagaccagaacagctgaacctgcacccgcacccgttcccttaaaatttaagagaatatattttttccgattgttctgctttatgattaaagcagaactttttaggcggtggttaatatgaaacaggaatacaagcggccggtgcttttcatcgcctcccttttcatggccttttgcgccgtttatttcggcgggaggctgatcggtttttatatggcggaatacccaaaatggaacgggcaaagcgccgacggaaattgggaggccgtgatcaaaaagatagatggccgcgcgctgttcggcggagagctctactggacaggcgaccgcggcaagctggacgatacatatttggaaaaattggtcgtaaagtttggtgatgaaatcgttttgaacgcccaaatcgaaacgccggtgaaagattacgcgggaggcaaattccccggcggagggtcaaaagaacaatccgtttcttttttggaagggcttgaagaagctgaaatcgccggccgcgaggtgacggttcaattggattggagagagggcaaacaagcgtcccatacaggatttacgcttgataaaagctcatggtaaaaggcggaatatcgattatattccgcctacctcaattttgcttcgcatcgtcagctcttcctgcggccccaaatcccgaaatccggtcacactcttcggaaggttcacgttcggtgcattcgtcatccaagtgtatggctcaatacaaagcagatcatcctgatcagatgtaccgttaaacacaacccagtgcttaaaatggccgtcgcattgatagcgtacgcgaatgccggcgaggctgtccgcaatgacggcggtgctgtttccttcttggtcttgctcagccgccaatatatcatcaagcctttcacccgctgccatttttcccgctttgaactcctctgtcacccgatactcgccagtcggcagcatgcggtctgtcagcgtccaatgctttgaggcaggaagagtaaacaggcacttttctttatcccctgattcgtttaaaggatagcggaaagatgtgtgataccccaatccgatcggcatcggatcttgac

SEQ ID NO: 128 - protein, 158 aa, Bacillus licheniformis
MKQEYKRPVLFIASLFMAFCAVYFGGRLIGFYMAEYPKWNGQSADGNWEAVIKKIDGRALFGGELYWTGDRGKLDDTYLEKLVVKFGDEIVLNAQIETPVKDYAGGKFPGGGSKEQSVSFLEGLEEAEIAGREVTVQLDWREGKQASHTGFTLDKSSW

SEQ ID NO: 129 - DNA, 1219 bp, Bacillus licheniformis
  CDS (812)..(1114)
gaccgctcgttaactcagcctgcttgcatcagcgcagatcttctgcagctactctcgaggcacgaggaaaccaaccgcttcacgggggaaaccaaccgcttcacgaggaaaccaaccgcttcacgaggaaaccaaccgcttcacgaggaaaccaaccgcttcacgaggaaaccaaccgcttcacgaggaaacctaccgcttcacgaggaaaccaaccacttcacgaggaaaccaacactcgagagctggttctcattatacagcacaaattcgatatctggtttcaattgcctgggctttagatgcaataggaactgtccttggcccttgaaacccacggttagcgaggcctcattataccgtattctcaataaactctctaatggttgaatcagaatagattttcgtctgcattcatcacttatcgtcatctgttcgcgtgtactgcgttccctaatcgacgtggaaccacgtgctgaacagtggactatctctcgctctctccataacctggcttatccttcgcgcgcggtcttaaaacatgctctcctataagcagctttgggtaatgtctgcttattccatcaccctcgcaaccgtgttttttgcaattatggacgcgctggaggcggtggttccaagtcagttcctcctgaactggtttgtgaactttatcatgctgtttctcgccattaaagaaacgccggcttctaaagcagcgaggtaaagcgggcaggagcaaatttgttgtcatgttggaagagggacaagcgtaacataataaaaaatgcacgaaatggggacaaatcagatgaaacgtgtcattgtgctgttttcgattttgctcgccctgttcattgtttattatgacttgaaatcaggcaccatccctcaaaacgccttaccggcttcaaccatggcagcggaagctccggctgcaagcctgcaatataagtccgttacggtaaagcccggacaaacggtattttcaatcatcgggaacagcgccgttccggctgacaaaatagccgaagattttgaagagttgaatccgaatgttgaggcgggccgcattcaagcaggtgtcacctacaagtttcccgtttatcctgattaagcgttaatttcttgtcagtttcatgaacgggctgttacaataagacttgtaaacgatttggtataagaaaaggagcaaccgcctccgaattatacttaagga

SEQ ID NO: 130 - protein, 101 aa, Bacillus licheniformis
MKRVIVLFSILLALFIVYYDLKSGTIPQNALPASTMAAEAPAASLQYKSVTVKPGQTVFSIIGNSAVPADKIAEDFEELNPNVEAGRIQAGVTYKFPVYPD

SEQ ID NO: 131 - DNA, 1381 bp, Bacillus licheniformis
  CDS (501)..(878)
ctttatatgcgacacaccagatgctccggttgtaacgactcccgccaggtgaacgaatgctaccgcacccgccggtgcgatgccgaaggcaagcagcaatgatgacgatgtcaccccgtacgccatccctaaggcgccatctatcagctgcgcaaataatcctatcaagacaaacacaatcagctttttcatgttggcctcccacttcaattggtttatttttattgttaaatataatctatactatgcctacctgtaaagtgcgagttttataaaatataaattttttgtatttttcatcgacaccagcaaaaaagagcatatgcatgcaaaatgagcgcctatcccccggtcttttgtcttaatgaaagacagtttatggatgctgcttgcaaaaaatgcatcgtgcagaaaaggcgtcggggagtaacgcctcattcgtttcattggcaatgatgatataatcccccatgtaatgacttcaaaaggaggctcaagccatgaaattcagcaaaatcggtgccttactgctcactttggcgtgtttgcttttgcctttttcttcggcgactgcagcaggtgccggtgtatgggataatatcggcacatacggcatgacgtcgcaaactccgatcatcaaatcaagcggaggggaattttattttcacaacaacagcttttacggctttacatttacgctgtatgaagttgacggggcgggaagcacgcctgaaatcgcaagaaaaaatttctacgtcggaccgaaaagcaacagtccggcgatcgatgtcagcagttttgcagatggtgcgaataaacaagcagaactcgtcctgtttaaagggaatgatacatatatcaccgttacttgttatgattgaatgtcccataaacagcaagcccgccgtttacagccggcgggtttttttgatcaagttccctccttatacctataggcacaaaaaagtgcctatatgacttaaaagtgcgtacttccgttttggtgtcttctgttccataatcataattgatgttttgtttgacattgttctgtttataatgaaaagaaaacggagggatcaatgatgaacttggatttacggggaaaaagagcgttggtgaccggatcgacgtccggaatcggcaaagcgattgccgcttcacttgcgaaagaaggtgcgtctgtcatcattaacggacgccggcaagaaaaggtcaaccaaacaatagacgaattgaaaggccaatttcccgaggctgttcttcaagcggccccttatgaccttggcactgaaaaagggtgtcaaagcctattagcagcattcccggatgttgatattctggtcaataatttagggatctttgaaccggcggaatattt

SEQ ID NO: 132 - protein, 126 aa, Bacillus licheniformis
MKFSKIGALLLTLACLLLPFSSATAAGAGVWDNIGTYGMTSQTPIIKSSGGEFYFHNNSFYGFTFTLYEVDGAGSTPEIARKNFYVGPKSNSPAIDVSSFADGANKQAELVLFKGNDTYITVTCYD

SEQ ID NO: 133 - DNA, 1581 bp, Bacillus licheniformis
  CDS (601)..(978)
gaattttccggaagctgaaacacccgtgatatatataaccataaattaaacagcataggcggattgtgcgagttcctccacattcggagtatttctgaatgatagagccacacggtccacgttctcactggctaaccggatcaaatgatcttcaggagtcagcataatacatccagttcaggtagataagatttgaatttggtgacttgcttttgttcttcttctttcattttctgactaatccaaactggaaaaagcaggtcttttaacagattaggaggtttctgacatgcaccattcggtcactaaccgaatgcagtaaaggacactgtggtgcttgccagccattagggtattgaggaggtgatcaaaatgctaggtgacagtatttcgtcgaagtggacaagtcgtgaccaaatgacctcggatcgagggttggtcatggaggaaaaaattgatgtctggtgacaaagaggagtcatgatcatggcaccgccaacgagggaaaaaactcttcccgcatcgacacggtatgtgggcggtgacaaactaacttatagagtaaatttattagtcgaatgaaagaggaggaatgaaataatgaaaaatcatttgtatgagaaaaaaaagaggaaacctttgactcggacaattaaagcgacgctcgccgtgttgacaatgtccatcgctttggtgggaggcgctacggtgccttcatttgcatgggtgaatccgggttatcactaccagtacccatcggaaggtggtacatggaggtatggattcgtaaacgccgggctccgttcagagtacaaccacccgacaaaggtccacggctcgacagtgcaaaagctcatcgatggaaaagtggataaaacgaatagaagtattgatacggctgcgggccgctactctaatgcctatgtcggagccataaactcacctggtcttaagggtcgttactactatcgcaccaactaatcaaagggaaaacggttgctgtcaacggggctagcatggcaagacccagaaaagttctgggagatcccgctttgcataagcgtattatagtggatgacgcgggctttgttgtttacacttcttgcacctgctgacggcaatcatccctatctatgaaatcgagatttcagcaggccgttattttcgagagagttaaatctatattcattgtttttattttggtaaggacataccggattttaggtttggattaccggtcgagttagcttgtcttttcgcccactaccgtgtcgatgcgggagcaatttaccagaagcacttaccgattgatagttttttattccggtgattgcaaagtttcataaactctgagaattcaataggggtaataccccgctttgaggggcgcggcattttatgcgccccgagtatttattcttaaaatttttaaattaatgtatctatataaaaaggagatgctttcggtgtactgccaaagcatctccacaaaagatagtgcatatctgcaggaaaaaacataaaatgcaactaacatttttttggaaagcaataggtttatttaattttgtagttttatct

SEQ ID NO: 134 - protein, 126 aa, Bacillus licheniformis
MKNHLYEKKKRKPLTRTIKATLAVLTMSIALVGGATVPSFAWVNPGYHYQYPSEGGTWRYGFVNAGLRSEYNHPTKVHGSTVQKLIDGKVDKTNRSIDTAAGRYSNAYVGAINSPGLKGRYYYRTN

SEQ ID NO: 135 - DNA, 1357 bp, Bacillus licheniformis
  CDS (501)..(854)
aggtctcttctagtcccgcccatcatcgggtctacacgtgagggaatatcgagctctaacatgagcggatgacatattttattcaagcgacacaatatattgcgctgtttctctccgtgtttgacgcaaaagagaagatttgcttttcgacgtctctaatattttcaaacagcaccgcttcagccgctgaaagcgcagcctctgagatttcccagctcagccgaacggtttcatgatccggcgaagttatttttaaaatatcgttacaaaacgaagaatcgcctcgaatactatgttgaaaaggttttttcccgatgattgtccttttcaccgcgcgccctcccgttaagccttgttatgtatctatcctattggaaatggccccgcaggcgcaacgaaaataaaattcttcgacaaaatttttattttttgcattaactccttttgaagcaagcgtttttatggtataaaaaagaaggagaaaattagaattgaaggtgatgaacgtggaaattgctatcattgcgctgctcgttgtcagtattgcgctgattgcattctcatattttcaaagagaaccgatcaaggaagttgaacaggagttggaaacccttcagctgtccgccatgcaggaaatctataaactgaaaaagaagatgaccgtgcttgaggaagagctcctcgattcaaatgtggtcgtccgcagaccgaatgccggaatcagccagcatattgcgaagcagattctttcaaaatatcaaaacggcatgtctgtagacgccatcgcaaaagctgagcacgtatctgtcgaagatgtcaaagcgatcattaaagactatgagagggtgcttgtatgaccagacagagtgtacaagcatttgcccggagaatggattgtggctaccgccgttcttgcaagcgcattttatttgaacggataatacgacccgatttacctgtgcgatgcgaagattctccgtcagcatcagactgtccgttctaaggccttcgataaagtagcgtcccatcgaataccaaataacgtagattaagaacagttcgcctctctttaaattcgcttttcttaaaagaagcagaacaacgactcccgtaaagctccacagcgattcatacaaaaaggtaggctggtagtattgtccgtcaatatacatttgattgatgataaaatcaggcaggtggaggttttctaaaaacgctcttgagaccgcctcaccgtgcgcttcctggttcataaagtttccccagcgtccgatcgcctgaccaagcagaatgcttggagcagcgatatcagccagcttccaaaacgaaagccccttgactttcgcataaatgattc

SEQ ID NO: 136 - protein, 118 aa, Bacillus licheniformis
MNVEIAIIALLVVSIALIAFSYFQREPIKEVEQELETLQLSAMQEIYKLKKKMTVLEEELLDSNVVVRRPNAGISQHIAKQILSKYQNGMSVDAIAKAEHVSVEDVKAIIKDYERVLV

SEQ ID NO: 137 - DNA, 1297 bp, Bacillus licheniformis
  CDS (501)..(794)
aggcaacatcgactcgatttcgtcacttttcggctacacagtcagcatgtcaaaagcaaagccgaccaatagtgagttcatcgcgatggtcgcagacaagctgagactggagcataaggcttcttaaacgttgatatgacgcagttttaacgaagatttaaccgtcgaattttcgacctgtttctaacgaatagtttatcgtaattccgatgaatttttcgcccatattgcgatgaaattgtgctacgatccgaagggtttaatacagtatttgaagggcctcgtttttataaacgaggccgtttttttgcccgcaaatgtactgtttgcgatgtaagatcaaaaaggtgaatcatttcagcacagtgtgtattgtgtaaagtcatcctaaaagcttatctattgattccgaaatattgtaatttgtacactttttggacatacctgcatgttatatgatgaaatagaaatgaaataaatggaaaaggagttgttttaaaatgaaggtcaataaattattaactggtacgactctggctgttggtttacttatttctgcagcgccggtatttgctgcatcgcattcatctgaggtgattgcacatccgactgctcaatatatcaattgtccaagtgacttgccaagctcattcaaaagcagtaaatcatcaaaatgtgtaaaatcatcttctggagttttcagtaacaaattttctgatagcgatggaacatggtatttcaaagggaaattttacagtaatgtttttaatacttgggttggtttttatgaaggatgaaccaaaaaaggggggctcccccttttttttgttttccttttagtatcaagtaggaaatagatggcggagaatgtaaaactcttcgaagagccgatctcgagttaaaagtatgaaataagcgggtggtatgatgatctttacgaaaacagatcttcgctatccggtgaattttttcgggccagggttgaggattaaccattacggattgctcatcgtaaacagcaatgcaaaaataggtgcaaactgtgacattcatcaaggggttaatatcggacaaaatcacgctcgccgcgatgttcccacaatcggagacaatgtctggatcgggccgggggcaaagctctttggcgacattcacattgctgacggcatatcaattggcgcaaacgccgtggtcaacaaatctttcactgaggaaaatattacaatagccggcatgcctgccaaaaagattaaagaggcgccgtcaaataaagaccggaagcaagctgttcagcggc

SEQ ID NO: 138 - protein, 98 aa, Bacillus licheniformis
MKVNKLLTGTTLAVGLLISAAPVFAASHSSEVIAHPTAQYINCPSDLPSSFKSSKSSKCVKSSSGVFSNKFSDSDGTWYFKGKFYSNVFNTWVGFYEG

SEQ ID NO: 139 - DNA, 1261 bp, Bacillus licheniformis
  CDS (501)..(836)
tcattaacattttccggtccgtcccgtttatcattttaatggttgctttaattccagtgacaaggctgattgtagggacgtcgatcggcacatcggcagcgattgttcccttgactttttatgcggggccttacatcgctagactcgtcgagaactctctgcttgaagtggatccgggagtcattgaagccgctgaagcaatgggagcgactccgagacagatcatcttcaggtttctgattccagaagcgctcggttcgcttgtgctgagttttacggtggcaacggtcggattggtcggggcgtcggcgatggctggtgcgattggtgcaggcggtcttggggatttggcgatcacatacggctatcaaagatttgacacgctgacgatgatcatcacggttgcaattctcgtcatcgtagtgcaaggattgcagacatccggaaacgttctgtcaaaaaaattgagaagaagatagacagagagggagacggctattatgaaaaaatttgcatgtgttgtgatcttcctgctgcttgcggcagtgatcgcggggtgcgcggcagactctgatgcgaaaaccattaaaatcggcatcagcggaacggatacgagaatttgggactttgtgaagaaaaaagccgaaaaagaaggcttaaagcttgaaatcgtcaaatactccgactatgttcagccaaaccaggctttggcgagcggcgacattgaccgccaacgcttttcagacgatatcctactttcatgcattcaaaaaggaacgcaacctttaattatcgccggtcggcacaacgacaccaggtcgggggggggaggaagaataaataaacacgggcccttttggttgataagtccccggcattacaagcccgaccattcccattgctgatccgcgtttttcctttgggaaaatcaataaaagcaccgtctgcatcaatggcatcataatgccggcgccagccgcctgcacgacgcgccccgcaatcagcgccggaaagctgaatgacaaggcgcagatcagcgtgccggccgtaaataaagacattgccgccatgaacagctttctcgttgtgaatttttcaattaaaaaagccgtaactggaatcatgatcccattcacgagcataaaaacggtcgtcagccattgggcaagccccggcgtaatgtttaagtccctcataatcggaggcagagccctgatgaatcccctaatgattttggtaaaaatcattaagttaaggtgga

SEQ ID NO: 140 - protein, 112 aa, Bacillus licheniformis
MKKFACVVIFLLLAAVIAGCAADSDAKTIKIGISGTDTRIWDFVKKKAEKEGLKLEIVKYSDYVQPNQALASGDIDRQRFSDDILLSCIQKGTQPLIIAGRHNDTRSGGGGR

SEQ ID NO: 141 - DNA, 1426 bp, Bacillus licheniformis
  CDS (507)..(923)
atcgtcaagtttgcctgcaatggaaggcaagaatttcttggaatattcgatcaccttgccgtcaatatcgacaagcgtcgcttttttcacgctcggatgcttcaaaatttcacggataacgccgccgtctccgccgccgaccacaagcacatgctcaggattcggatgcgtaaacaggggcacgtgcgccaccatttcgtggtagacaaattcatctttttcagatgtcatgaccatgccgtccaaaaacagcatgttgccgaattcttcagtctcggccatttcgagcttttgaaaatctgtctgctctgtatgtaaagtcctgttgattttcattgtaataccgaaatttttcgtttgcttctctgtataccaaagtccgctcaaagcgtcatcttcctttcgtgataagctgtatttcaatctatttttctcgcctgcggcggcgattattctgcactgaagcatcggcttttgcctaaggaaaaagtatagaggaattgcaggtgattgtaaagacggatcgattcattttcacgagtcattccaagtccattatattcccaatcgccagtttttcttttatattggctaagctaagcacagatgtgcatacctgtgcgcttttggaggtgtgctcatttgcagagcactcaactgctcaaattgtatatatcctcccgccggaacaggcttttattgaccttttttctgatccgaccggccgttttgtctttcacccccgttcatatccgggacgctgcccttccccctctcccggatcggccttctcgaaattcagcggatttgcttatttgatgcctatggtctctcgctctcgtccctatgctgttgttttacgttacttcaaatgtctgccgggctctccgcgtcccacgccaccaaacaaacggggtctcccctgattttcgtcggctgcccgtctctgctttttgattaccccccttctcttattgaagcccgcctcggctggtttccatcgtccgctacgcgccgcaaatgttatgcttttctttatctaaaggctctacccttagtatctaactaacacctgcatgcacagaaatcggagtggctttgtgcatgcaccgacatcggagtgggtctgtgcatgcaccgatatcggagagactctgtgcatgcaccgatatcggagtggctctgtgcatgcaccgatatcggagtggctctgtgcatgcaccgatatcggagtggctctgtgcatgcaccgatatcggagtggctctcatgcacgtgttgatgaatgcggcccatgtacgtgttgatgaatgcggcccatgtacgtgttgatgaatgcggcccatgtacgtgttgatgaatgcggccattcttatcaggggaccccaacgggattcttatcaggggaccccaacgggattcttat

SEQ ID NO: 142 - protein, 139 aa, Bacillus licheniformis
VIVKTDRFIFTSHSKSIIFPIASFSFILAKLSTDVHTCALLEVCSFAEHSTAQIVYILPPEQAFIDLFSDPTGRFVFHPRSYPGRCPSPSPGSAFSKFSGFAYLMPMVSRSRPYAVVLRYFKCLPGSPRPTPPNKRGLP

SEQ ID NO: 143 - DNA, 1513 bp, Bacillus licheniformis
  CDS (496)..(1035)
ggaacggccggcacatatgtgacgggtatttttatgggcgagaccttttcaggagggcaaatattctttttgatcgtgctgttgggaggcattattggcatgaagatgtttacaaaagagaacaatgcccagtcaggaggtgatgaatgatgccatggatgtttttagtgatttccggaatcgaagaggttattgccgccatcgctatgaaatatgtagacggcacaagaaaaaaatggccgattatcgtcatggtgttggggtttggcttgtcttttttctgcctttcaaaagcaatgcagatgctatcagccggtgttgcatatgccgtatggaccggaatcggcagcatcggcattacggcagtcagtttattttggtttaaggagcgtattcgtgctccgcagctcatctcgcttggctttattataatcggggtgatcggcctgcgccttacatcatcttaaattttaatttgcattggaggttgctgatatgattaatcagcttaaattgcgtccgcttgaaagagaagaccttccgtttgtccaccgtcttaacaacgatgcgaaaattatgtcatattggtttgaagaaccgtacgagacttttgttgagctgcaggatttatttgacaaacacattcacgaccaaagcgagcggcgctttatcatagagaaagagactgagatgatcggattggtagagctggtcgaaattgattatattcacaggcgggcggagtttcaaatcataattgatcccgagcatcaagggaacggttattcgtcaagcgcaacatatttggcaatgaactacgcattttccgtcttgaacttgcacaaattgtatttgatcgtcgacgaagataatgcaaaagcgattcacttgtataaaaaggcagggttcactatcgagagcgagctgcaggatgaatttttcgtcgacggctattatcgtaacgccattagaatgtgcatttttcaggatgagtttttatcacttaaaaaaagcaaagaggaaggcatgcagggataaataaaagagatggcggcgccatctcctgcatgcttttttaatttttcacacctaattgctctttggctttggcgggaatatcgtctttgtcaacctcttcccatgacttcacgcctttgttttcagaatagaaaagcctcaaaaacgcgcctatgcgaaggtttttatcagctgtgaattccattgttttttcttgaccgtcttcatcaaaaccggccagttcatatttgaagacggagtattcctcgccgtcgtcaaatttcgacgtgtcttcctccccgtttccagtaatgtgaacataatattcgtccgtccccacacggtttaagttacatccgcttaaaaatgcggcaaatatgatcatcaggctgatccatggaatatgggtttttcactttttctcctcatttatggtttctgtgtaaatgataagattcattgtctgataaaaaaattgaataacgtgacatgaaca

SEQ ID NO: 144 - protein, 180 aa, Bacillus licheniformis
MINQLKLRPLEREDLPFVHRLNNDAKIMSYWFEEPYETFVELQDLFDKHIHDQSERRFIIEKETEMIGLVELVEIDYIHRRAEFQIIIDPEHQGNGYSSSATYLAMNYAFSVLNLHKLYLIVDEDNAKAIHLYKKAGFTIESELQDEFFVDGYYRNAIRMCIFQDEFLSLKKSKEEGMQG

SEQ ID NO: 145 - DNA, 1763 bp, Bacillus licheniformis
  CDS (503)..(1264)
gccgctgacctaagggagcaagctcccgtcggtccgctcgacttgcatgtattaggcacgccgccagcgttcgtcctgagccaggatcaaactctccatgaaataatggagcgcagattaagttcgtcacatcctgtgacaacatctgcatgacctgcatcgtgcaggcccctgactacgcacactcaaatgtgcgatttataaaaatgaattaacaggtacgttttgtcttgtttagttttcaaagatcatttccgcttcgttcagcggctttaataatataacatcaagctcacatatttgtcaataacttttctcaaaattattttttggagctttttcatgtcagctgtttatcagcgacgaataacaatataacatgtttatttaattccggtcaaccctctttttaatttttttcttaagatgaattattgttatgttctattttaaacaagcataggatgaaaacaaagcagcatggacaaggaggagtttttctgtgaaccatttttatgtgtggcatatcaaacggattaagcagctaatcattattatgatagccgcttttgcgacagcaagttttttttatgtgcaaaacctgctccctcttcctgtgttttctacagaaggcggagcaaaagcggtatatagaggagattcagatacaaatgaagtagcccttacatttaatatcagctggggagatcaaaaggcaatgcccattttagacacattaaaagcaaacggtattaaagacgcgaccttttttctatcagcttcatgggcagagcgccacccggatgtcgtagaaagaatccgtaaagatggtcaccagatcgggagtatgggctatgcttataaaaactattcgcaaatgaagaaaagcgagatcaaaaaagacttagcaaaagcacgacactcctttcaaaaactcgggcttgacgaccttacgcttttaagaccgccgaccggccagtttaataaagacgtactcgatgttgctaaacagtacggctacaccgttgttcattatagtattaactcggatgactggacgaacccgggggttcaaaagatcgtccaaaacgtaaatggaacggtaaacgccggtgacatcgtgctctttcacgcttcagattccgccaaacaaacaaaagaagccctgccagagatcgtgcaccatctcagaagcaaggggctcaaaaacgtaacagtcagcgaattaatcgcaaatacggatgcaaaatcttcagaagtaaagtagcagccggtctaagcgcgtgcctgaaattttggcagcattaaaagctgaaaagcgttgcaggctaataaaggaagcagcattaaatagagccagtcctcttcattgacccttaacgccgggaaccactccatcacagtaaaaacaaacattagaaataatgcggaaacgaacgtttttttagaggactgtttttgctttgcataagcggccgcaatgcctaccgccaaaataaagagcggcagccaaatgtacggaatgatggagcctccatctttttcaaaaaacagaaagcgcaagtaaaccaagtcaaacgcgacaaatataatcaaaaacagctgaatcgaattccacaaagaatgagatctgaaaatttccagtgcaaagcggtgaatcgttaagaaaatcacaaatcccatttgagcaatcacgctaaagatcatgccaaccccgataaaccagaaaagaacagacagaatctccaatacctcgaaggaaa

SEQ ID NO: 146 - protein, 254 aa, Bacillus licheniformis
VNHFYVWHIKRIKQLIIIMIAAFATASFFYVQNLLPLPVFSTEGGAKAVYRGDSDTNEVALTFNISWGDQKAMPILDTLKANGIKDATFFLSASWAERHPDVVERIRKDGHQIGSMGYAYKNYSQMKKSEIKKDLAKARHSFQKLGLDDLTLLRPPTGQFNKDVLDVAKQYGYTVVHYSINSDDWTNPGVQKIVQNVNGTVNAGDIVLFHASDSAKQTKEALPEIVHHLRSKGLKNVTVSELIANTDAKSSEVK

SEQ ID NO: 147 - DNA, 1855 bp, Bacillus licheniformis
  CDS (480)..(1346)
tgtaaacgggaggaggtattctggaggacatgataggtaagccggggtgatagtcacagtaaatagggagattataacatagagaagatgcagatcagtgatggggagggcgaagataacacacgaggaagacgcggaataaggaggaacatagtgacgcagggtgaacggtagggagggtggcaaatagtagtatgatatttgaaagacgggtcccgtacgaaatcggtgaaaaacaaaggcggaaaaacgaagtacaagccgtatgtttcaaaagcgctttatgatgccaataagaagctggaccgcgataaagacaaaattgcctgtgagcgctgatatatccaaaaaaagatctctgccaagggatctttttttgtttatcaggaaatttatgaaaattaaagactgctgaaacataatcttaacagtgcgaacctatactttggcaagagaagagcaaaaggggagtggatgatgtgtcagctttattcaaaaaattgatgttatcttcattgatcggggtttccatcgggtcagcgctgtttgcaccgaatgcgggtgcacaagagccggcggtgaagcctaaaaaagtggatgtcattgcacacagaggcgcttcgggatatgcgccggaaaacacgatggctgcttttgataaagcgcttcagatgaaagcagattatatcgagctggatgttcaaatgtccaaagacggggagcttgtcatcattcacgatacgaccgtaaaccgtacgacagatattgactcagtgctgccggttgccgtaaaggatttgacgcttgccgagctgcgcaagcttgatgccggcagcttcttcggtccgcagttcgcaggagagcgcattccgacatttgaagaagtgcttgaccggtataaagggaaggtcggaatgctgatcgaattgaaagagcctgcacgctatccgggaatcgaaggaaaagtgtcagcagcattgaaagagcggagaatggataagcctaaaaacggaaaaatcattgtacaatcgtttgattttaactctgtctataaaattcatcagctgcttccatcgatgccgacaggtgtcttgacgtcaaaagcggcggacttaacagatgcaaagcttaaggaattttccggctatgccaaatacgtgaacgccaacttgaaaaatgtggccgctgatcctacgcttgtgccgagaattcatgcgctcggcatgaagatacgcccttggaccgtccgctcccgcgatgaagtgcctccgctatttaggcccgcgtggaacgggattgtgacaaactttcccgactattgttccaaaaaagtacgggagccccaataaaaaaccctgaagtttgctttgaagggctttttaatttaaaaataaaaatggggcttaaaacaaaaaaggttaacgttaacgggtttatcgttccccccgattttttttgggacacctgggaaaaacgggtataaacctttgggggccctttttgggggccttaaaaattttgaaatttgccccgggggccctccttgtggccggaggggggaaaattttttttttattccggggtttttataggggggcaaaattttaaacccccttttctctcaaaaaaaaaaacccgggggtttttttttttgggtactgccgccgatgaccttacatatgggctgaactgcaaaaacaatggaagaggaaaacctgcaggcccgcatcgtctcattcagcgttgatcccgaaaatgatacgcctgaaaaattgaagaaatttgcggccaactacccgctcagttttcaaaattgggactttttaaccggatactcgcaggaagaaatcgaaaa

SEQ ID NO: 148 - protein, 289 aa, Bacillus licheniformis
VSALFKKLMLSSLIGVSIGSALFAPNAGAQEPAVKPKKVDVIAHRGASGYAPENTMAAFDKALQMKADYIELDVQMSKDGELVIIHDTTVNRTTDIDSVLPVAVKDLTLAELRKLDAGSFFGPQFAGERIPTFEEVLDRYKGKVGMLIELKEPARYPGIEGKVSAALKERRMDKPKNGKIIVQSFDFNSVYKIHQLLPSMPTGVLTSKAADLTDAKLKEFSGYAKYVNANLKNVAADPTLVPRIHALGMKIRPWTVRSRDEVPPLFRPAWNGIVTNFPDYCSKKVREPQ

SEQ ID NO: 149 - DNA, 2200 bp, Bacillus licheniformis
  CDS (501)..(1697)
aaaatacgcgcaataaaggagaaagcaatgagcaatatagaagaacttcgtctttttcgaaaagaagatattgaatggctgcagacctggtttgaggatgcagaggtgaaaaggcggctggaagggatgctccctcttgacgaatggttcaattttgcaggcggtaatgaaaactaccgggtatgggcggctttagaggacggcaagcctgtcggcgttgtcatggttgaagttgaggaggacttgaccgggaacattgcccttttagtcgatccgtttttgcgcggagggggatatggaaaagcgctcatcaaaaggacgatggcattgccggaaatgagccggatcaacaaatggttcgccggaattgaagaggataacaagaggtgcttagcgtgcttccgatccgtcgggtattcattggaacacgaacagccggacgaagactgctactactctcttatttatttcccggaatcttaaataaggagcataagaagatgaacttgatcaaatggattttgttttccgttatttcattcgccttttttcagccggcaccagccgctctattaaaagaaaaggacgactatactattcttgtttatatgattggttctgacatggaaagcgattttcatatggcaagcgatgacattcaggaaatgatggatgcgggttcatcttcaaacgtcaatgtcgttcttcagacaggaggagcaaaaaaatgggcgaacccgtcgatcagtcacaaggtgaatcagaggtggaaagttgaacatcagaagctggtgcccctcgaaaatgtcgggaagaaaaatatggacagtcccggctccgtcacagattttatcacatggggagtcaaaacatatccggctaaaaaatatgtattgatcttttgggggcatgggcttggctcagttgacggctacgggggagacgaaaacttcggcaataagaaaatgaaaataagcgagctgcagtcgggaatcaaaacggcctatgaacatacgaagcaaaagtttgatttaatcggttttgacaactgcaaaatggccgggattgaaacggcatatgccttgagggattatggtaagtacatgctggcttcagtcgactatacgaatcaaaacggctgggattataaaagggcgctgcagtctgtacaagacgacccttcaatcgatccgaaagagcttggcagggaaatcgctgcaggctacgtacagcagtcaaaagaaaacggtgaaacagaagacctgcagcagtctttaattcaattgaaccgtgtcaaagacgctgtcgatgccctcgacagattgagcgtaaacatgaacctggcattgaaagagcctgacggaaagcgcctgctccactacgcgcgtctcgctgctgaagattatgcagatgaatcggatatggttgatttggcggatttgtcaagcttgatcggtcagcagatcggagccgagaaagaagcaaaagaggtcgtaaaatccgtcaagaaggctgtcatcatgaacatcaaatctccggagcatccaagaggaagcggcatgtccgtttattatccggccagagacaaccataagcggtttgcggaaaaatcgaaaatataccgcctgcttgacttcagcagccggtatcaaacattcatcaaagattactcgcattcaacatttaactttgatctatagttgcgtttaacagcaaaaaagcgccggcggaaaaaccggcactttttttatcggctcatgtgcttccggatcaatggaagtccgtagatgatgaaagcggcgacatgggcgatgacaacgttgagaataaagagtgcgatcatgagagagtgtcctgtaggagaaaggctgctggtcatatagaaaaagaagaatacccacattaaaatgatgggcggaatagaagaaattgcgacctttttgttgtccagccataaaaataaaggagtggcgcttgcaatcagcaagtaagcgaaaaacatatccatgcgttttcagcccctttcgataatgatagcgctgtcaaaaaaagcggaatgaaacatcaattgtgtctaattggagaatattttgtgaacattctgttacatttattataccacgttcttcgaaaaatgatacatactggaaagcattttccgctccaactatcggctcaattttcacggtgattcagttag

SEQ ID NO: 150 - protein, 399 aa, Bacillus licheniformis
MNLIKWILFSVISFAFFQPAPAALLKEKDDYTILVYMIGSDMESDFHMASDDIQEMMDAGSSSNVNVVLQTGGAKKWANPSISHKVNQRWKVEHQKLVPLENVGKKNMDSPGSVTDFITWGVKTYPAKKYVLIFWGHGLGSVDGYGGDENFGNKKMKISELQSGIKTAYEHTKQKFDLIGFDNCKMAGIETAYALRDYGKYMLASVDYTNQNGWDYKRALQSVQDDPSIDPKELGREIAAGYVQQSKENGETEDLQQSLIQLNRVKDAVDALDRLSVNMNLALKEPDGKRLLHYARLAAEDYADESDMVDLADLSSLIGQQIGAEKEAKEVVKSVKKAVIMNIKSPEHPRGSGMSVYYPARDNHKRFAEKSKIYRLLDFSSRYQTFIKDYSHSTFNFDL

SEQ ID NO: 151 - DNA, 1170 bp, Bacillus licheniformis
  CDS (501)..(674)
tggctctatccggacagcatccgcatcaaggtcgcgcttgacgacggcgagattaccgggtttaatgcaaaggatttcttaatctcccataaaaaaagagacttgccgaagcccaaactaacgcctgaaaaagcgaaagcaagcctgaatcccaacgtaaaagttcaggagacgcgccttgctttagtcacgaacgagctttcgcaagaagtgctctgctacgaaattctcggcacgattgaaaacgatacattccgcatgttcatcaatgccaatgacggcacggaagagaaggttcagaaaatgaaaagcgcagaaccgatatacaacgacttgtaaaaacgatagatcaaagggaaaaggcgataacatgccttttcctttttagcattcggaataattcgccctaaacatttccatactgaacatatgggcggaacgtccgccggtaaattgaaaatgcccggggccataaattttccgggcagcggaggaataatatgaaaacaatcgaacggttattatttaagatactcgtcgtacagacggtcattttaatcagcgtgcagcttctttttcatttctccaaggctgagccttatctgtcaaaggtcgtgcagtatgaaggcgtgaacaacatgaaaatcggcgaatggatcgagacatttaagccgtaattcacgctaaaatctcccctttttcgcctaatacatgatacaatcctataaggagtaccagatagcaaggagaggaattatggaaaagaaattatgcattgcaatagacggccctgcggcagccggaaaaagcaccgtggcgaaaatcgtggccagaaaaaagtcgtatatttatattgatacgggtgccatgtacagggcgattacgtatctagcgctggaaaagggcgttgatttaaacgacgaagcggcgctgacggccttgttaaaagaatctgccatcgatctcacggtttcgcctgaaggagagcagaaggtttatatcgcaggcgaagatgtaacagaggcgatccgcacggatagcgtgagcaaccaagtctccatcgtcgccaaatacgccgggatccgcgaagaaatgacgaaaaggcagcagcagctggctgaaaaaggcggagtcgtcatggacggccgcgacatcggaacccacgttctc

SEQ ID NO: 152 - protein, 58 aa, Bacillus licheniformis
MKTIERLLFKILVVQTVILISVQLLFHFSKAEPYLSKVVQYEGVNNMKIGEWIETFKP

SEQ ID NO: 153 - DNA, 1435 bp, Bacillus licheniformis
  CDS (501)..(932)
tatcgtctttgtcaacctcttcccatgacttcacgcctttgttttcagaatagaaaagcctcaaaaacgcgcctatgcgaaggtttttatcagctgtgaattccattgttttttcttgaccgtcttcatcaaaaccggccagttcatatttgaagacggagtattcctcgccgtcgtcaaatttcgacgtgtcttcctccccgtttccagtaatgtgaacataatattcgtccgtccccacacggtttaagttacatccgcttaaaaatgcggcaaatatgatcatcaggctgatccatggaatatgggtttttcactttttctcctcatttatggtttctgtgtaaatgataagattcattgtctgataaaaaaattgaataacgtgacatgaacattacacttttgtaagggatcgttttagcacacgcaggcaaattaaatttcaatatcctttttattcaataaagtttataatatggaaaaaaggaggggcgccaatgaaaaaaatcgtatgtttgatggtgttttcaatcatgacggccttcggtattcacatccagcctgctgaagctgcggttataaaagatgagaaaaagatgaccatgacaatgactgaagatcatgtgggattttttatggcggacagcaccaatgtaaattactacccgacatggctgtattacaagcttacgatttttaacgcggaaggctgcacactcaacatcaagctgcagagaatcacgttaacaggacatgcggtcactttaagcgagaaagagtatacgggaaatcatcttcatttaagtgctgcagataaagtgagcgggtcgccgcaccgaaatcatttcttggatatcacaaaagtgtcggggtgcggggatgttggaatcacaggtttttacggctttgagcaccaaatgccgggctactaattgatatagaaagcgcgggaggggacttttccagagtccttttttcatatcatcgcaaaaaatgctaaatatcaggagaaaaaacaaacgctgcttttattgagaggcgccatcctcttgctgctatgttctgcggctggttatgctctttatcagcatgttgccggaggccggaatgaacaggcaggcgccgtccttcatcagcaggcattacattttaaattatcgactttagagggcggtgacatcgaactgaaaaaatgacggggaaaggcggtgcttgtcaacttttggggggctttttgtacaccgtgcaaagaggagatgcccgtcatgcaaaaagcttatgaccgttttaaaggagacggttttgaaatcatcgctgtcaatgtgcgtgaatcgaaaggtgcggtaaagagctttgtcgaccgccatggcttaacttttccggtcgctttggatcaatcggctgaagtttaccgttcttgggaaatgtatta

SEQ ID NO: 154 - protein, 144 aa, Bacillus licheniformis
MKKIVCLMVFSIMTAFGIHIQPAEAAVIKDEKKMTMTMTEDHVGFFMADSTNVNYYPTWLYYKLTIFNAEGCTLNIKLQRITLTGHAVTLSEKEYTGNHLHLSAADKVSGSPHRNHFLDITKVSGCGDVGITGFYGFEHQMPGY

SEQ ID NO: 155 - DNA, 1768 bp, Bacillus licheniformis; identical to SEQ ID NO: 65
  CDS (501)..(1265)

SEQ ID NO: 156 - protein, 255 aa, Bacillus licheniformis; identical to SEQ ID NO: 66

SEQ ID NO: 157 - DNA, 1688 bp, Bacillus licheniformis
  CDS (501)..(1652)
gatgtcctcagcaacttgagaaaactggcggtttactgtgaagaagggcttgcggcctgccgaatcaggctgcagcaggatccttttcaggaggctgcagccgaaaggacgctctatcaggtctatcatcgatgcatagaagaattttttacaccgaaaaaagatacttggtacgaagacagcagagcggcctacacgggaaaaaacgccatttgctttcacgaaccagcgccggcctcattaaaaaatttgatggcttcgcttgaaacaggatatcaatcgatgagagaagaattggaatactatgcgactgactatcgaatgaagatggttcagccgagatcatagcttaaatgaaccgtgagccggaactccccctttcatgaaaggggggtttttatcttgctttagatttttctcgggaaatcatccaattggtgttcataacaaaaagacaagcgcataaacttgtacaaacaaccacaaggacgtgagaaaaaatgcgcttttttctaaaacaagcggcagcagccatcatgatatgctctcttttatgctcttcatacgaaaccgctcaagcacagccctcccttcatatcagcgcaaaaagcgcgattgtcatggacgggcaatccggacgggttttgtttgcaaaggatgagcatgaaaaacggcgcattgcaagcattacgaagattatgacagccattttggccgtggaatcgggcaaattggatgagacggtcacggtcagcgacagagcggtcaggacagagggatcatcgatctatttaacaagcgggcaaaaggtgaagctgaaggaccttgtttacggtttgatgctgagatcgggaaatgatgcagccgttgcgattgccgaacatgtgggcggaagcctggaaggctttgtctacatgatgaatcaaaaagcggccgagctcggcatggaaaacaccctgttccgcaatccgcacggacttgatgaccaccctgatcactattcctcggcctatgatatggcgcttttaacaaaatatgcgatgagcaatgaaacgtacaaaaaaatcgccggaacgaaacgctataaagcagaaacgatgcaaggcatctgggagaataaaaacaagcttttaacagggctttacaaatacagtacaggcgggaagacgggatatacaaggcttgcaaagcggacgctcgtctccatttcatcgaaagacggaaccgatttgatcgccgtcacaatcaatgcccctgacgactggaatgatcatatgaacatgttcaactatgtattcggccagtacaaaacatatatcatcgccaaaaaaggcgagattccgaaattaaaagactctttttacggacatacagcttttattaaacgggatgtcacatatcttttaaacgaagaggaaaaagaagatgtgaaggttgatatcgagcttcttgaaccgaaaaaatcatggcgtaaaaacaaaaaagaaatcccggacatcatcggagaaatgaacgtcatgttcgacggaaaaacgattgcaagcgtaccgatctattatgaaaacgagcgaaacaaaaatccgaaaaaatcgtttttcgagacctttcaatccgtattccaaaaagcggcgggcggttcatcatggtcaatataatctgggtcggcttaacggtgatcggtatggtgt

SEQ ID NO: 158 - protein, 384 aa, Bacillus licheniformis
MRFFLKQAAAAIMICSLLCSSYETAQAQPSLHISAKSAIVMDGQSGRVLFAKDEHEKRRIASITKIMTAILAVESGKLDETVTVSDRAVRTEGSSIYLTSGQKVKLKDLVYGLMLRSGNDAAVAIAEHVGGSLEGFVYMMNQKAAELGMENTLFRNPHGLDDHPDHYSSAYDMALLTKYAMSNETYKKIAGTKRYKAETMQGIWENKNKLLTGLYKYSTGGKTGYTRLAKRTLVSISSKDGTDLIAVTINAPDDWNDHMNMFNYVFGQYKTYIIAKKGEIPKLKDSFYGHTAFIKRDVTYLLNEEEKEDVKVDIELLEPKKSWRKNKKEIPDIIGEMNVMFDGKTIASVPIYYENERNKNPKKSFFETFQSVFQKAAGGSSWSI

SEQ ID NO: 159 - DNA, 1617 bp, Bacillus licheniformis
  CDS (501)..(1118)
cggatggcttctaacaattcggaaatccttggggaattggacggggaaagcgggcgaaaacctgctgctgcggcttgctttacagccccgggtattaaagataaggtacggggtgtaaaaaattcagcgggtgaggtggtcgacatgaggaaaggagtcatccttgttctgttcgctatgctgttattggcaggctgcggcacaacgcagcataatgggcaaagcggtgatgagagccgaaaaggaacaggcgaggaaacgctcgtgaaagaaggcacctttgtcggtttggcggaccagcataccgtcgccgtcaatattgacggcaaagaaacgatgtttcaggtccctcccgaaaaacgggacaaatataaagggatcgaggatgatacaaaggtggaagtggagtacacgaaagcagaggacggaacattacagcttgaagatatgaaaaagaaagaatgatcgtttgcaaaaagggattgtaggaggaacaaatcgtgaaactgttaataaagagttttgttttgctgctgttttcgtttatggcggcttttccagctgcttttgcggctgagccgctttccgggaagacggtatatgttgacgcaggtcacgggggtgaagacagcggtgctgtcggaaacgggctgcttgagaaagatgtcaaccttgaagtggcaatgctgattgatgaaaagctgaaagaagaaggagccgacacagtcgcctcaagaacggatgatacgtttttgacgctggaagaccgggtggccaaggcgagcaaaaatgcttcagacttgtttatcagcattcatgcaaactcggccgtccctgaagcgtccggtacagaaacatatttcgattccacgtatcaagccgctgacagcgaacggctggcatctgacattcaagagcggcttccggatgcgctgggcactcgggacagaggtgtaaaagaatcagggttttatgtcatcaaaaattctcaaatgccgagtgttttagtcgaactgggctttatcacaaacaaaactgatgcagataaactcgaaagtccggaatatcaggaaaaagctgcagacgcgattgctgacgctgtcgtatcttattatgaataatagaagggccctggtatatgaccggggttcttgtgttatgtttatgttaaaaaaggccttatgtgtggaaagaaaacagtaagaccttcataatgggttataaacttgcaattcttgtagaggtgaaccagaaatgacgaaaatatttgcacacagaggggcttcaggcacttttcccgaaaatacaatggcggcgtttaagcatgcggcggccattggtgccgacggcatcgaattggatgttcaaatggcaaaagacggacgtcttgttgtcattcatgatgaaaagcttgacaggacgacttcactgaaagggtatgtgaaagatcttacatatgaggaaataaaacatggagacgcaagccaccgttttgccgaaaaaaccggttctgtccctgtgccgacccttgaagaagtgtttgagtgggcggcagatgctgaatttcttcttaatgttgaattgaaaaacagcattatccgctatgaagggatggaa

SEQ ID NO: 160 - protein, 206 aa, Bacillus licheniformis
VKLLIKSFVLLLFSFMAAFPAAFAAEPLSGKTVYVDAGHGGEDSGAVGNGLLEKDVNLEVAMLIDEKLKEEGADTVASRTDDTFLTLEDRVAKASKNASDLFISIHANSAVPEASGTETYFDSTYQAADSERLASDIQERLPDALGTRDRGVKESGFYVIKNSQMPSVLVELGFITNKTDADKLESPEYQEKAADAIADAVVSYYE

SEQ ID NO: 161 - DNA, 1803 bp, Bacillus licheniformis
  CDS (165)..(1487)
atacagttcatagccttcatgaacatgcggcgcgttcatctcggtaaatccttttctctgcatatattgaatcgaaaaagaatgctcggctatgaaatatttaggatggagcatgtcgggcattcctccttgagagcgttttcttaacaaacgggagggatcgtatgaaaaagttatgttgcctgatcttggtcttggttttttccgcgggctgtactcagcaaaaggcatcaacggaagaggacggggcgcttgaaatcaattggctcgtaccgctccacacaccgcagcctccgaaagagaaggcgcttgacatcattgaagacaaaacgaatacaaagctgaagctcatctgggttccggattcaacaaaagaagagcggatcaatacaacccttgcaagcggaaacatgcctaaagtaatgacattgcctgatcttgaagattcagcggttgtcagcgcgctgcgctcgggaatgttctgggaaatcggaccgtatttcaaagactatccgaatttaagaaaacttgataaaactatattgaaaaatatttcggttgatggcaaagtttacgggatttatagagaaaggccgatggccaggcagggagtcgtgattcggaaagactggctcgacaatctcggattggaaatgccggaaaccgttgatgacctttataaaatagcgaaagcatttacagaacaggaccccgatcaaaacggaaaagacgacacgttcggtctcgccgaccgcaatgatctcaccttcggagcgtttaaaaccctggcttcgtactttggcgcgccgaacgaatggggaacggacgaagacggaaatctcttcccctattttaagcatgaggcctataaagacgcaatggcatacatgaaaaagctttatgaagaaggcctgatgaacagggactttgcggtgacaagcaaaacgcagcagcaggatttagtgattcaggggaaagcgggaatctatatcggcgcgatgagcgatgccatgaacttgcgtgatcagggactcgctttgaaccccggctttcagcttgatatcgcaaaccggatcaagggccccgacggcaaggagcgcacatgggcgctcggcgggcatggcgggatgttcgccatttcgaaatcaagcgtcaagactgaaaaagaggtcagaaaaatcctcgcattttttgacagaatcgctgaagaagacctcaacaatttgatgttgtatggaatagaaggcgtacactatgaaaagaaaggggggagcggctattttcgaaagcaggaaaactaccatctgtgggaagcggaaattcagccgttaaaccagctgattggcgtcaataaacaagctttaaaaagcgctgaagatccgctccgcgccaaaaatgaaaagcttgaggaggacaaccgggcaatcgcagtccagaatccggccgaaccgtgtattctgccgcacagatggacaggggaacagaattgaagaaaatcattgatgacgccacatttcaatttattctcggggaaatcaatgaaaaagctttgaccaggcagtcctgaaatgggagaagcatggcggcggaaagatcatgaaagaactgaatgaagatctgaaaaaagcaaactaaacagaaaaccctttccatttttttgaaaaggaaagggtttttcatcgtattcgctccaagttcattttctttaaattctgcaaaataaacaatataattccatcataggacgaaaaggaggaagcgatatgcagactgccgttatatatgcacacccaaatccaaaca

SEQ ID NO: 162 - protein, 441 aa, Bacillus licheniformis
MKKLCCLILVLVFSAGCTQQKASTEEDGALEINWLVPLHTPQPPKEKALDIIEDKTNTKLKLIWVPDSTKEERINTTLASGNMPKVMTLPDLEDSAVVSALRSGMFWEIGPYFKDYPNLRKLDKTILKNISVDGKVYGIYRERPMARQGVVIRKDWLDNLGLEMPETVDDLYKIAKAFTEQDPDQNGKDDTFGLADRNDLTFGAFKTLASYFGAPNEWGTDEDGNLFPYFKHEAYKDAMAYMKKLYEEGLMNRDFAVTSKTQQQDLVIQGKAGIYIGAMSDAMNLRDQGLALNPGFQLDIANRIKGPDGKERTWALGGHGGMFAISKSSVKTEKEVRKILAFFDRIAEEDLNNLMLYGIEGVHYEKKGGSGYFRKQENYHLWEAEIQPLNQLIGVNKQALKSAEDPLRAKNEKLEEDNRAIAVQNPAEPCILPHRWTGEQN

SEQ ID NO: 163 - DNA, 1400 bp, Bacillus licheniformis
  CDS (501)..(983)
tcgcccgcaggtgattaggcagcaaacgatgaatgatgcgcatattcccgtatccgccaccgagcaagactaaatttctcattggtaattccccttttcccctcagattaagaaactcaccttttacactgcaaaaaaaaaaaactatgtaaaaaccatatagaattatatctaatttgatgtgaaatcacaatatttctcgggaaaataacatacactaacgcctagaatcgataattagtaaaactctttaaagtattaatatgttacaaaagctttattctccagccttaaactttgactaatgaaacgcatttagggtacgataaaaagtcgatgtgaggtgagataaggtgtcaaggcgcttttgaaattgaagcatctgctggataaagtggtgcaatagcatgtaagctgccggcatgaaaccggcagcattttttaagcgtccgacgggaagtctttttttgattaaatttcatggttagcgagtgaaaaatatgtcaacaatattatggcttgtgagcttcacgctccacggtatattgatttatttcgtcatcattttgaatacgaggctcagcgctttcaaggcagcggagaaagagcaaaaacagcttttggaagaaaccgagaatacattgaccgcttttttgatggagttaaaagacgaaaatgaaaaactcgttcaagagattcgggcgaatgccgaaaaagagccgcaaagaccggaaacacagcctgaaattcccgctcaaacccccgtccttccggaagcggacgaatcgcgcgatctgccgcttcacatcgaagcgatgatcaatgaggtggagcaggaagaggatgagctcaatcaaaaggagcaggaagcatccatatcctatgaagaagaagctctcgcattagaaaaacatggggactgggggaaagaattttttcataaaacaggccccaaaatgggggggggtggtgttccagtctcttaaagaaaaaaaaaattcaacctctcttctttggggaggggggggggggaaaaaataaggtgttggtagaggggggaggaatttttttttaaaggaaaccctcatggggagggagatgtgctttaaacgagggagggagcgaggaaatggcactggttccataggatgaaacgcgcgggattgtctccagaaaacagggagaccccggaaaaggagcggggcagccaattcatcactttttaagtttcaaagcctcagcaaatttgggggttaaaaattcacacggaattggttgggagggaataaggagagtttaaaaacccgccaatttatcaagagggagccgcagggaggaaaatacaatccacggatcctaagtggtgagatgtcatggggggatatggtttcggactcgaa

SEQ ID NO: 164 - protein, 161 aa, Bacillus licheniformis
MSTILWLVSFTLHGILIYFVIILNTRLSAFKAAEKEQKQLLEETENTLTAFLMELKDENEKLVQEIRANAEKEPQRPETQPEIPAQTPVLPEADESRDLPLHIEAMINEVEQEEDELNQKEQEASISYEEEALALEKHGDWGKEFFHKTGPKMGGGGVPVS

SEQ ID NO: 165 - DNA, 2644 bp, Bacillus licheniformis
  CDS (502)..(2142)
caccggggcatgtttcgcttttccggcagtcggacagaaccttgatcgcaggggacgccgttacaactgttgagcaggagtctctatttgaagtggcaattcaaaagcaggagctgaacggaccgccggcttatttcacaatggattggacaaaagcagcagattcggttcggaagctggcaggattaaaaccggctgcattattgacgggacacggtgtaccgatgaaaggaagcgatttttccgaagcgctccttgatctatcagaccgcttgcccgcctctgattcgtaaattgtcatatgctgcgcttaaaacattcagccaggctgaatgtttttttatagggaaaaactaaccattttacatgtgatgatggccgtccattgttctaaattccggatgttgatgtataccaaaggaatcattttctgaaattttagacaaaatatgttgatatttcatttataatgcaggtatgcctgaaaggagctgagaaaagatgaaaattcaaaaaagggtccaagctttgctggcaacttcggcaatgtttgcaggactgatgctgtccgatgcggtgtacgctgcggaaaccccttactatggaaagaactatactcagccagagcaagtgtcatcattatatccggagcctgaagaaacattctcaacccctgcttttgtaaaagaaggggaagcctttacgacacaagaagaaatgatgaagtttataaccagtctgacaaagaaaagcccgaatgtcaaaatcgggaatatcggtttttcaattgaaaaaagaaatattcctgtgctttacttcacaaaggacaagcaaatacgttccatatcaaaaaaaccaaccgtctggctgcaaggacagatacatggaaatgagccggcagcgggagaatctgctctggcgatagctgaaaaactggccggaccgtatggcgacaaagtgttggacaagatcaatgtcatcgttgttccgcgggtcaatcctgacggatcatatcagttcaacagacggctggcgaacggaatcgacggaaacagggatcatgtcaagctcgagtctccagaagtgcgcgccattcaccaagaattcaataagtattcgcctgaagtcgttatcgatgcccatgaatacggtgtcggccaaaacgaatttcagagcataggcgaaaaagggtcattaaaataccatgatattttaattttatcaggaaaaaatttaaacattcccaagtcgatcaggcatgcgtccgacagcctttatgtgaacggcgtcagagctaaacttgatgaaaaaggattttctaatgatgcttattatacgacaggaaaaagcaaggacggaaaaatcgaaatctatgaaggcggtacagaagcgagaatcgggcgtaatgcattcgccctccagcctgccctttccttcctggtggaaagcaggggaatagacatcggacgcgaaaattttgcaagaagagtcgcggctcaggttgctacacatgagacgatcatcgacacgacagtgaagcatgcagccgagatcaagcgccttgtctccaaagaaaaattaaagctgatacaaaacggcgctaaagtgagcgataaagaccaagtggtcatcaacagtgagtttgcaggcccgtttaaagacacgcttaaagtcgctgatattgcctcaggacaagcagttgacgttcctgtccaatattacagcgcctcagaggccgttcctgtgctgtcaagaactcggccgaccgcttaccttgtccttccgggccatcaagatatcgaacagaagctgaaggatcagggattaaagagcgtgacactggctttcaaacaaaaactcaccgctgaagcgtatgaggttttatcgaaagaaacagcgggagaatctgagggccggccagtgatcaaggtagaaacgaagctcaaaaaacagaaaaaagagtttcctaaaggaacaaaaatctattttacagctcagcagcaaagcaatctgctgtcaatcgcacttgagccggagtcggttgacagttatgtaagcacaggttacattccttctcaaaaaggcaaagagctgccggtttaccgcttcatgctgaacaccaaaacgcttaattttaaggaataatcaccaggcatccgtctttgacggatgctttttagcggttttttgttttttcatacataattgttttaaactgagatcgaaacctatacaataaatatcagtctgaaatctggaaggagagaatccggttggaatcacatgaagaattatggagggaagccaaggccttcatcgagctctgctacggggaactgtcgaagtccgaagaagaaacaaggatgcgcttacataaaatagataaagaaatcagagaaaccggaagctatacacatacattagaagaaatcgaacatggagccagaatggcgtggagaaacagcagccgctgcatcggcaggctgttttggcactctcttactgtcatcgatcaaagaggcgttcaaaccgaggcagaggtgcgggatgcgcttttccaccatattcagcttgcaacaaacggagggaaaatcagaccgttcattacggttttccccccggaacaaaacggacacagcgaagt

SEQ ID NO: 166 - protein, 547 aa, Bacillus licheniformis
MKIQKRVQALLATSAMFAGLMLSDAVYAAETPYYGKNYTQPEQVSSLYPEPEETFSTPAFVKEGEAFTTQEEMMKFITSLTKKSPNVKIGNIGFSIEKRNIPVLYFTKDKQIRSISKKPTVWLQGQIHGNEPAAGESALAIAEKLAGPYGDKVLDKINVIVVPRVNPDGSYQFNRRLANGIDGNRDHVKLESPEVRAIHQEFNKYSPEVVIDAHEYGVGQNEFQSIGEKGSLKYHDILILSGKNLNIPKSIRHASDSLYVNGVRAKLDEKGFSNDAYYTTGKSKDGKIEIYEGGTEARIGRNAFALQPALSFLVESRGIDIGRENFARRVAAQVATHETIIDTTVKHAAEIKRLVSKEKLKLIQNGAKVSDKDQVVINSEFAGPFKDTLKVADIASGQAVDVPVQYYSASEAVPVLSRTRPTAYLVLPGHQDIEQKLKDQGLKSVTLAFKQKLTAEAYEVLSKETAGESEGRPVIKVETKLKKQKKEFPKGTKIYFTAQQQSNLLSIALEPESVDSYVSTGYIPSQKGKELPVYRFMLNTKTLNFKE

SEQ ID NO: 167 - DNA, 2146 bp, Bacillus licheniformis
  CDS (501)..(1643)
aagaaaaaccgatgaaagaagagcctgccaaggatggcaaagatgataccgcgcctgctaaagacaaaactaaagggaaagatacaaaagataaagaaacgtctgcgagtgagcagaacggagaggttgtcacagaggaatcatcgggtgatgaagatttattcacaacataccgcatggaaatggacgatcagcgcagcagggagagggaggaattaaccgaaatcgtcagaagcgataaagcgacggcaaaagaaaaaagcgaagcttacgacaagatgacagagctcagcgaagctgaaggaacggaaaagacccttgaaaccctcatcaaaacaaaaggctattaagacgccttggtcaacgccgacggcgataaagtcaatattacggtgaaggcgaaggagcactcgaaagccgcctgcaccgagtttacatttcctcaaatgatagttttcattgatttgctagtataagtgttatcaaaaggaggttaatatatgaacttttacaaaacgctcgccttatcaactcttgcggcatccttattgtctccctcatggagcattctcccccgtgccgaagcttcagcttataaggacttctcggtgactgccgatgcagagacagagccggtggatacccctgacgacgcggcagatgacccggcgatttgggttcatccgaagcagcctgaaaaaagccggctgatcacaacaaataaaaaatctggcttgatcgtttacgatttaaacggaaaacagctggcagcctatccgtttggcaaattaaacaacgtcgatctccgctacaattttccgctcgatggcaaaaaaattgatattgccggggcctcaaaccggtcagacggcaaaaacacggttgaaatatacgcctttgacggcgaaaaaaacaagctgaaaaacatcgtcaatcctcaaaaacctattcaaaccgatattgaggaggtgtatggtttcagcctgtatcacagccagaaaaccggcaagttctacgccatggtgaccggaaagaacggagaattcgagcaatacgaactgtttgacaacggaaaaggacaagtcgaaggcaaaaaggtccgctcattcaaaatgagctctcaaacagaagggcttgcagcagatgatgaatacggcaaaatgtacatcgctgaagaagacgctgcgatttggtctttcagcgccgagccaaacggcggagataaaggaaaaattgtcgatcgcgcaggcggaccgcatttaaccgctgatattgaagggctgacgatttactacggagaagacggcgaaggatatttgatcgcgtccagtcagggcgataaccgttatgccatctatgaccggcgcgggaaaaacgactatgtcgccgatttttcaattgatgacggtaaagaaatcgacgggacaagcgataccgatggaatcgacgtcatcggcttcggcctcggcaaaaaatatccatacggcatctttgtcgcccaagacggcgaaaatacggaaaatggacagccagccaatcagaacttcaaaattgtctcctgggaaaaaattgctgacgcgctggacgacaagcctgatatcgatgatcaggtcaatccccgaaaactgaaaaaacgagccaaataacgacggatccgcgggaaatgcccgcggatttttcacattcctttatgttaagataactattaatggagggatggtattgcgtttaaatctctatgccgtagtgtttatcatgttggcggttttatcaaatgtggtgtttctctgcgtttttaatcaaggtgtattggcgtacacttctgctgtcatcttcctgcttgctgctgcatattgcacgaagcgtcggcctgaaaagtaaggcttcctatgccttatggcttctccgtaaaatgctcgttccgtaaggcggcagtttgagcgcgccttttttccgggttccctttaaaacgtccgtatttgtttcctccggaagcgagacacttctgttttccgctgtaaaattcatcacgaaaatataatcgtggcggccgtctgtgcggagctgggcggtgacgcctttcgggagctctgtatcgagcactttggcaatcccgcactcttcaatgagcctggatataaacgcc

SEQ ID NO: 168 - protein, 381 aa, Bacillus licheniformis
MNFYKTLALSTLAASLLSPSWSILPRAEASAYKDFSVTADAETEPVDTPDDAADDPAIWVHPKQPEKSRLITTNKKSGLIVYDLNGKQLAAYPFGKLNNVDLRYNFPLDGKKIDIAGASNRSDGKNTVEIYAFDGEKNKLKNIVNPQKPIQTDIEEVYGFSLYHSQKTGKFYAMVTGKNGEFEQYELFDNGKGQVEGKKVRSFKMSSQTEGLAADDEYGKMYIAEEDAAIWSFSAEPNGGDKGKIVDRAGGPHLTADIEGLTIYYGEDGEGYLIASSQGDNRYAIYDRRGKNDYVADFSIDDGKEIDGTSDTDGIDVIGFGLGKKYPYGIFVAQDGENTENGQPANQNFKIVSWEKIADALDDKPDIDDQVNPRKLKKRAK

SEQ ID NO: 169 - DNA, 1301 bp, Bacillus licheniformis
  CDS (501)..(803)
gaactgtccttggcccttgaaacccacggttagcgaggcctcattataccgtattctcaataaactctctaatggttgaatcagaatagattttcgtctgcattcatcacttatcgtcatctgttcgcgtgtactgcgttccctaatcgacgtggaaccacgtgctgaacagtggactatctctcgctctctccataacctggcttatccttcgcgcgcggtcttaaaacatgctctcctataagcagctttgggtaatgtctgcttattccatcaccctcgcaaccgtgttttttgcaattatggacgcgctggaggcggtggttccaagtcagttcctcctgaactggtttgtgaactttatcatgctgtttctcgccattaaagaaacgccggcttctaaagcagcgaggtaaagcgggcaggagcaaatttgttgtcatgttggaagagggacaagcgtaacataataaaaaatgcacgaaatggggacaaatcagatgaaacgtgtcattgtgctgttttcgattttgctcgccctgttcattgtttattatgacttgaaatcaggcaccatccctcaaaacgccttaccggcttcaaccatggcagcggaagctccggctgcaagcctgcaatataagtccgttacggtaaagcccggacaaacggtattttcaatcatcgggaacagcgccgttccggctgacaaaatagccgaagattttgaagagttgaatccgaatgttgaggcgggccgcattcaagcaggtgtcacctacaagtttcccgtttatcctgattaagcgttaatttcttgtcagtttcatgaacgggctgttacaataagacttgtaaacgatttggtataagaaaaggagcaaccgcctccgaattatacttaaggagcgaattcaagtgagtgaaatcacacatcgtacaaaaacgcgtcccgttaaagtgggacctttaacaataggcggcaataacgaagtcgtcattcaaagcatgacaacaacgaaaacacatgacgttgaagcaaccgtcgccgaaatcaacagactcgcggaagcaggatgtcaaatcgtccgcgtcgcctgtcctgatgaacgggctgccgacgccattccagagatcaaaaagcggatatccatccctcttgtcgtggatattcatttcaactataaattggcattaaaagcgatcgaaggcggagccgataaaatccgcatcaatccgggtaacatcggccgccgcgaaaaggttgaagcggtcgtcaacgcagcgaaggaaaagggcat

SEQ ID NO: 170 - protein, 101 aa, Bacillus licheniformis; identical to SEQ ID NO: 130

SEQ ID NO: 171 - DNA, 1627 bp, Bacillus licheniformis
  CDS (501)..(1124)
cgggttcatcagcttgtcacatcgctaaagaaaacggctcagtcagacgatgaatttctcttcaatctcggaaaagaactgacagattgcagctttagaatttacatgtgcgatgaagacggtattcagctgacgaaaaacgtgtttaagcatgacggagcatggatatttcagcctgagtacatcggcaaaaattggagctggcgcccttattttctcgagaatatcatgaggatgagaacgatgagaaaagggtttttcagcgatttgtacagcgatatcgaaacgggggaaatgatcagaacgttttcctatccgatggatgaagaattgtatctgttcattgacctgtcctactcatatttatacgaacaagacggattaatttaagcggcggcctttcgccgctttttctttttgaaaaaatgaatcccgagaggtttgtttcgcgtatataaaggaaaatgtgaaaatataaatgctaaaaaggggtggatcatatgaagaacgtttggtcatccttactgtgcgcgcttctggctgcggctcttgtattcttctgcgcggattttgccaaagccggagaaaaaccgacaagagcatcgttatttgagacccttcaatccgtatcggacgtccattttcagctgaccgaaaaggaaagaacgaaaacagacatgatatccctcttggaaccttatatggagcacgccatggcagtgaagtatgtagaggcgaacgcctttcctgaacaagcggggtggattttttacgggacagacgcgcctgaagttgcaatccctttcttcagctatggcggagacacaaaagtggcggggaaagacggaagctataccgtatatgaatttgttggagatcaaaacgacggccctgtttcatatcaaaaaaattatcagacggtgacgctgaagaataccggcggcagcttcaaagtaacggatatcggccaatctgatacaaaaccggctggagaagaaataatgtccaaacaaccggatgaaaaagaaacaagctcgaattttgcggataaaggggaaggagaccaggctgcatttccgctttttgccaccgatgttaactggacattggccggaattttcagctagcaaaagaatttaaagaaaatcattgacaatgatactgataatcattatcatttaattatagagagatgaacctctctgttccccaacccctctatcagatcaagatttaaaaaacttggcgctgcccccgccaagttttttatttgcatggaatcccgcacttcaaatagctgcgggatttttgggcattaggcgcgcgcaggaataagacaatcctttgctccataaatctaaattggtggttcaaatagactcctctgcagtcaaaaaaatatttttcatgtatgacatgaaaaaagaaaactcaaactatgaaaaagcggtttttctttttcatgatcaaaaaggaaaaatgtcatcggctgatactttgtggtatgatgctttgtagaacttgtattataattaatacttgttgatcctgaagttgtttttttgaaaggagtcttttttagaatgtcacaattaatgggtatcatcacgagactgcagagcctgca

SEQ ID NO: 172 - protein, 208 aa, Bacillus licheniformis
MKNVWSSLLCALLAAALVFFCADFAKAGEKPTRASLFETLQSVSDVHFQLTEKERTKTDMISLLEPYMEHAMAVKYVEANAFPEQAGWIFYGTDAPEVAIPFFSYGGDTKVAGKDGSYTVYEFVGDQNDGPVSYQKNYQTVTLKNTGGSFKVTDIGQSDTKPAGEEIMSKQPDEKETSSNFADKGEGDQAAFPLFATDVNWTLAGIFS

SEQ ID NO: 173 - DNA, 2297 bp, Bacillus licheniformis
  CDS (501)..(1802)
gacatcgccgccaagatgcgggatgggattgagaaattgatggaatcgctgatcctttctggcctagtcatgctggttctcgaccattcaaggccggcttccggcggcgagcaccatctttcccactaccttgaaatgaaagcgctggagaacaataagcggcaagtgctccacggtgctaaagtcggctgcagcgcgattatgctgactgacatttaccgatctcttatcggtgcaagcctgggtgatcaacacgctgagcaagcgattcgctccgtttatgaaaagctccctgacggtaagaaaatggcagagtggatgaggcgtatcggcgggcctgtatcattcaaagaactcgatgttgaagaagagctggtgagagaagcgctcgcatacgcccatcagctcagagaccggtatacgggactgaaaatcatcaatcaatacggccttttgccggggcttttaggcaaaggaccaggcgtgaaaggggttaaaatgtgaaaaggttcctttcatctatctttatggtcacggtcgctgtatgtttgcttttatcggggtgcaaggcgagtcctgcctccgatcaagcggacggcaccgaactgacattttggacattcaacggccttcatgaacagttttatgctgagatggtgaaagaatggaacaaaaagtatcccgagcgaaaaatcaaattaaatacagtggtgtatccgtatggacagatgcatgacaatttatctatctcgcttttagccgggaaaggggttccagatattgccgatgttgagctggggcgctattcgaactttttgaagggctctgacattcctcttaccgatttaacgccgcttgtggaggacgaacgcgacaagtttgttgaagcgaggctgacgctctacagcaagaacggcaagctttacggacttgacacacatgtcggaactaccgtgatgtattacaacatggaaatgatgaataaagcaggcgttgatccggacgacatcaaaacatgggaagattacagggaagcgggcaaaaaggtcgtcaaagctctcggaaagccgatgacgacgattgaaacgaccgacccgaattcatttctgccgctggtttcccagcagggatccggttactttgatgagcaggggcggttgacattaaacaatgagacaaacgtgaaaacgctcgaatttttaaagactttaattgagaaagacaaaattgccgtcacaacgcccggaggcaatcatcacagtgaagagtattacggatttatgaaccaaggcggcgcggcgtctgtcttaatgccgatctggtatatgggccgttttttggattatatgcctgacttgaaagggaaaatcgcgatcagaccgctgccggcatgggaagaagggggagaccgctcagcgggaatgggcggaacggccaccgtgattccaaaacaggcgaaacaggtcgatctggccaaggatttcttgaaatttgccaaagcgtcaaaagaaggcaacatcaagctgtggaccgtgctcgggttcgatccgctcagatgggatgtgtgggactcggacgaattgaaaaaaccaaatcaatatacagaatactttcaaaacggacaacacatcttttccgtgcttcttgacataaaggatgagatcaatccgctttaccttactgaggattatgcgaagacttccgatctcgtcaacagaaacatactgtacgaagcgctcaaaacgaagagcaaaacaccgaaagaagcattggacaaagcagcagctgaagtgaaagggcaatagtctttcattactgtaaagcgaggcgataacttgaagactgttaaaacagatacagtgcattcgtttccgccggtgagcagaaaaagaaagatcagacgtttattatattcagcaaaagccgcaccctacatttttacagcaccttttgtactctccttttgcatattttttctttatccgcttatcagcgtcgtcatcatgagttttcaaagcattctccccggggaagtccgcttcatcgggacggagaactataaagcattaaacaatcctacattttataccgcactattcaacaccgtaaaatacaccttttggacattgctgattttaatacctgttcctcttattctggcagtctttttagattctaaactcgtaaagtttaaaaacgtgttcaaatcggctttattcatcccggctctgacttcaaccattgtggcggggattattttcaggctgatttttggagaaatggatacatccctggcg

SEQ ID NO: 174 - protein, 434 aa, Bacillus licheniformis
VKRFLSSIFMVTVAVCLLLSGCKASPASDQADGTELTFWTFNGLHEQFYAEMVKEWNKKYPERKIKLNTVVYPYGQMHDNLSISLLAGKGVPDIADVELGRYSNFLKGSDIPLTDLTPLVEDERDKFVEARLTLYSKNGKLYGLDTHVGTTVMYYNMEMMNKAGVDPDDIKTWEDYREAGKKVVKALGKPMTTIETTDPNSFLPLVSQQGSGYFDEQGRLTLNNETNVKTLEFLKTLIEKDKIAVTTPGGNHHSEEYYGFMNQGGAASVLMPIWYMGRFLDYMPDLKGKIAIRPLPAWEEGGDRSAGMGGTATVIPKQAKQVDLAKDFLKFAKASKEGNIKLWTVLGFDPLRWDVWDSDELKKPNQYTEYFQNGQHIFSVLLDIKDEINPLYLTEDYAKTSDLVNRNILYEALKTKSKTPKEALDKAAAEVKGQ

SEQ ID NO: 175 - DNA, 1864 bp, Bacillus licheniformis
  CDS (533)..(991)
tatgcgctgcgagcactgcgccgtcgggtatacgctccagacgaaggacccggacgcgctgccagtcagccttctgttgaaacggcttgatgagattccccgccttcgttctttaagcattacgggcggcgagccgatgctctcattaaaatctgtaaaggaatatgtcgttcctttattaaaatacgctcatgaacgcggcgtgcggacgcagatcaactcaaacttgacgctcgatatcggccgctacgagctgatcatcccctacctggatgtgcttcatatttcccacaactggggaacggtcgaagactttgcagaaatcggcttcgctatgatggataaaaagccgacgtttgcacagcgggcgcgctatttcgaaaaaatgatcgaaaacagccggacgcttgttgatgaaggggtcatggtctccgccgagacgatgctcaacaaacggacgcttcctcatatcgagcatattcaccggcaaattgtcgaagacatgaaatgccagcgccatgaggtccatccgatgtatccgagcgactttgcaagcgcacttgaatctttaagcttaaaagacatgagaaaagcgatccaccgccttcttgacattcgcgacgaaaatacgtggatgctgttcggcactctgccgttttacgcgtgcagccctgatcctgaagatcacgccctcttacagcggctgcgcgaagcgaaaaacgtcaccgtcagaaacgaccctgacggcagatcgcgcctgaacgtcaatatttttgacggcaatatcatcgtgaccgatttcggagatactccgccgctcggcaacattcagacagacagcctgccaagcgcctacgcgaagtggagaaaaacagagcttgccaaagaactcaactgccactgcccgcacgtccggtgcctcggaccgaatgtgctcgtcaaaaacagctattatcaagatgttgattttacttccagaacagcaagagtatgaaaaaagcaagccgcaaaggcttgcttttttatttcggctgatggctgagctgaaagccgaatgtcaggtgatcctgtacaggaatccaagcgccgattccttgcgaggtgatatttttgacgactagctttcttttgttgccttttaatacgatgtacacttcgccgtaggtgacttttcctttttcattgacggcaggtgcataggcgtgtaaatttcccagttttttcggctgcactttataaatctgatcgcgttttgtaccggagccgaccactgtttcaaaggcgagcggcagctttgttttttccatggctttgagcatcatcatatttttgacatcttccgcctttggaactttcgctgttaagccgcctttgattttgctcgtctgttcctgggaatacgtgagttctgcaggtgctttcccgccccggttgtcaaagcggtttgtgttgattttgcggtattcccagttcgcaacggtttcattcgaggtgtaacctagcgcccatctgcccaaataaatcgtcgcccgatagccgattgccagcggtgtgccggaaatgcttgactcattcagcattttaatcagatgcggattttcaatcgcaatatcggttgttttcagcagctcttcggctaattcgctcggctgcagcctcggctgatcctgagaggcgttagggtatgtgttctctttggaaatattcgtgacagagcttggaatcttgatcggcttggctgcgtcagcttcctgtacagcgaaaaaactaaaggataaaaacgcagtcagcgtaaaacacaaaagctttttcatactatcactctttctgtttctttttccttattgttttccggatgctctct

SEQ ID NO: 176 - protein, 153 aa, Bacillus licheniformis
MYPSDFASALESLSLKDMRKAIHRLLDIRDENTWMLFGTLPFYACSPDPEDHALLQRLREAKNVTVRNDPDGRSRLNVNIFDGNIIVTDFGDTPPLGNIQTDSLPSAYAKWRKTELAKELNCHCPHVRCLGPNVLVKNSYYQDVDFTSRTARV

SEQ ID NO: 177 - DNA, 1763 bp, Bacillus licheniformis; identical to SEQ ID NO: 145
  CDS (503)..(1264)

SEQ ID NO: 178 - protein, 254 aa, Bacillus licheniformis; identical to SEQ ID NO: 146

SEQ ID NO: 179 - DNA, 1610 bp, Bacillus licheniformis
  CDS (501)..(1304)
agaaaaaatgcaaacaaatcaaatcgttaaagatgacgaattgtttgaacggttaagggcgctgcgcagaaagcttgctcaggaacaaggcgtgcctccttttgttgtattctctgacgaaacgctgcgggaaatgagcgggaaagtccctctgacagacgaagagcttttgtcagtcaaaggagtgggagaacaaaaaagagtaaaatacggagctgtatttctacaggagcttcaagcctataaaactgagaaagaagcataaaaacccaaaatttatatatgtaaaattttttttagtaaatctcctatttcagttgaaaaacgattggaacccttgatacatctgaatttcggccgattttagggcggctgaaattcctcctcgtaaaacaactgtaatcaaaaacaaattgttttgttattgatttgacattttcatatgttacgattgctcctgttagccggacaataaaaagctaacaagggaggatttacttatgaagaagacgtttatgtcctttgttgcagttgcagcattatcttcaactgcattcggagcgagtgcctctgcaaaagaagtaacagtccaaaaaggtgacaccctttggggaatctcgcaaaaacaaggggtaaatctgcaggacttaaaagaatggaatcagctttcctctgacttgattattccgggacaaaagctgaacgtttctgaaaaacagacagaagaaaagaaacaatataccattaaaaagggagacactctctggaaaatcgcccaaaaattcggcgtttcagtgaatgaccttaaaaattggaacaacataaaatcagatatcatttacccgaatacatccataactgttgacggacaggcgacggtccaggctgctgcggcgcaacctgcggaaacaaagcctgccgtacaaaaagaagcgaaagtcgagaaggctgcgcctgcccctgcacctaagcaggaaaaagaaccggcttcccgttcaaacgtatctcaaagcactgccaaagaactgacggttacagcaacggcatacactgccaatgacggcggtatgacaggcgtgacagccacgggtatcgatctgaaggccaataaaaacgccaaggttattgcggtggatccaaacgtaatcccgcttggatccaaggtgtatgtggaaggctacggagaagcgaccgctgccgataccggcggtgcgatcaaggggaacaaaatcgacgtatttgttccaagcaaatccgcagcaaaaaactggggcgttaaaacggttaaagttaaagttttaaaataataggtttaccattgatggacactgaccatgaagatgatcagtgtcttttttctgttttctgcatctttttttctattttgatgtttttttagattggcaaatgggtagttcaatagataaatacatatcagctgatctaaaaaggagttgcagaagtattggtgtggattatcatgacatttttattgattaatgcaggaatttttattttttcttatttgaggacaaaagatattgatttaaaaacgtcagacggctattttctcggcgggcgcagtctcactgccctctatatcggaagtt

SEQ ID NO: 180 - protein, 268 aa, Bacillus licheniformis
MKKTFMSFVAVAALSSTAFGASASAKEVTVQKGDTLWGISQKQGVNLQDLKEWNQLSSDLIIPGQKLNVSEKQTEEKKQYTIKKGDTLWKIAQKFGVSVNDLKNWNNIKSDIIYPNTSITVDGQATVQAAAAQPAETKPAVQKEAKVEKAAPAPAPKQEKEPASRSNVSQSTAKELTVTATAYTANDGGMTGVTATGIDLKANKNAKVIAVDPNVIPLGSKVYVEGYGEATAADTGGAIKGNKIDVFVPSKSAAKNWGVKTVKVKVLK

SEQ ID NO: 181 - DNA, 1547 bp, Bacillus licheniformis; identical to SEQ ID NO: 69
  CDS (501)..(1046)

SEQ ID NO: 182 - protein, 182 aa, Bacillus licheniformis; identical to SEQ ID NO: 70

SEQ ID NO: 183 - DNA, 1317 bp, Bacillus licheniformis
  CDS (501)..(818)
agcttcaaatcgctcccgtcccactgcttctcatcttgaggaaaagttgaggccgctttcattgtcatgctgtatgtttccacatcatgaaatgatgcgtttgtatgctgtgacagctgactccccaatccaattaacaggtatatgatcagcagcgtttgaaaaacgataatgttttttccggctctttttcggcatctcctagttcgagataatcggaacatgactaccctcctagcgagtatgtaatggcttttgtttccgttcgttttaaagaactttatagttagagtataaagaacaagtgtgccgtttgaaaactgtcaaaaaagtcgattaagttcgttctaaagaacattttcgtttaattcctcaaaaaacctctcaaattctcatctttttgaaaagtttgtagttctttatagtgtacacaatttcttcttaatttttgtataaacactgttgacaaggaaaaaataggatagaaaggatgatgacccgtgctgaaaaatgtcatattatgttcttttttactgctttctagcattgggccgctcaatgcccatgcggcagcttacgaaacagcccgcatgtctaagtgggaagaaaaagcggttgaggaagcaaaaaagagatatccggaagcagaagtgcgcctcacgaaaaaagtatgggatcgaaagcgggccgatgaagcggtcaaacaataccatgtcacattgagtgaaggaaataaaaatttcggagtgtttgtcacaatttcatttgaacctgcgacacacaaaattaacaaagtcgtcgttgtggaagaatataaataagccgcattgcagtgcaaagcggcttgtctttatttatgctttttaaaaaacatgatacagccaaggggaagaatgccgaaccattgatatatcctggacggcggctttaattctttacgtttttctttcatttcttttctttcctgcttaggcgtgtccatatattttacgagctgttccgtcatatatttaacataatcgttcgttttcatcgcatcacctcttggggagttctgtcagttgaagtgttgtcatccgaatctttttttatacattcttcatgatttggacacacaatttttaatattccttccactgcgtgattttttgatttcttaaatcatattgaaattgagcgcttgtttctgtgccggaagctgtcgttacctgaatctggactcgtgtgagctgctgatgagccgggctgacagaatacgatatcaagccatgctgtttttgaactttttcttttgtctcttcgtgaatatgggacaag

SEQ ID NO: 184 - protein, 106 aa, Bacillus licheniformis
VLKNVILCSFLLLSSIGPLNAHAAAYETARMSKWEEKAVEEAKKRYPEAEVRLTKKVWDRKRADEAVKQYHVTLSEGNKNFGVFVTISFEPATHKINKVVVVEEYK

SEQ ID NO: 185 - DNA, 2347 bp, Bacillus licheniformis
  CDS (518)..(1906)
acagggttcaaattggtggcggccggcgttccggctcagcggcgtcatcggccgggcggaaatgctcgatgcggcggatccgggtgaactcgggggcacctacgccggaagtccgcttggatgcgtagccgctttggcagtgctcgatattatcgaatcggaacagctcaacaagcgctctgaagaaatcggcaaagccatcgaagagcgggcgcttgaatggaagatgaaatatccgcagattggggaagtccgccgacttggcgcaatggctgcgattgaaattgtccgggacgaaaagacgcgggagccggacaaagcagctgcggccaagattgccaagtacgccaatgaacacggtctgctcttgttgacggcagggatcaacggcaacattatccgttttctgtctccgctcgtcattactgatgaattacttgaggaagggttcggcatcattgaagaagcgctggaacagctctagtttgacatcttctaaaagaaggagcggattttgatgggtaaacagcaaatgaaaaaaacgatgtcgcagacggatgtgctatttttagcgatcggagctatgctcggctggggctgggtcgtcctttccggcgactggatttcgacagccggctttttgggcagcacgatcgcgtttatcatcggcggcatactcgtcatcttaatcgggttaacgtacgcggagctgtcttctgccatccctgaaacgggtggcggcttgattttcgtctacagggcgttcggacgaaaaacggcttttgtcgccgcttggggtgtgctgttcggctatgtttcggtgattacatttgaggcggtcgcattgcctaccgtcatcgattacgtcctgcctgtcgaacatcaggggtttctctggtcgctaagcggctgggacgtgtatgtcacttgggtgttgatcggttcgggaggtgcggtcgtcctgacagcgctcaattacttcggcgtcaagccggccgcgatttttcagtcggtctttacgattgcgattatcgccacgggctttctccttttgggcggcgccttggtaaacggtgatttcgaacatgtacagcccctttttaaagacgggttttccggtatgatgtccgtccttgtcatgattccgtttctatttgtcggatttgacgtcatccctcaggttgcggctgaaattaatgccccgaaaaaaatcatcggcaaaattttgattatttcgattatcagtgcggtcgtgttttatttgctgattgtattcggcgtaacgatgggtctgtcagaaagcgagcttgcgacgacttctttggcaaccgcggatgcaatggtcaatctgctcgggaaccagctgttcggcacggtgcttgtcctcggcggcgtcgccggaatcattacgagctggaacgcatttatcatcggcgcgagccggattctgtttgcaatgtcggaaaagggcatggtgccgaaatggttcggcttcatccatccgaagtataaaacgccgactaatgcaattttatttctgggtgcgctggcgttttttgccccgctgctcggacgccctgcccttgtttggatcgtcaatgcagggggaacaggtattatagtcggatatttgatcgtctcgattgcattcatgaagctgagaaaaacagagccggatttacacaggccgtataaaatcaataagtggaaaacaacgggtatatctgctatcctcttaagtgttatcttccttgccttttatttgccaggcatgccggccgcgctcacatggccgtatgagtggctgatcttggcgggatggacattgatcggttttcttttatacaacagcagttcaaaacgtaaaggggaggagattcaacatgaccagcatgctagaagtatataatcctgcgactggagaaaaaatcaaatcggttccccagcaatccgcaaaggaagtcgaagaagctgtcgtacgctcgcatgaggcatttcaaaaatggtcgaaaacatcggctgcagaacgagcgggcttgctgaaaaaatggtttgatttaattgtggagcagaaggacgagctggcaaaattgattacgcttgaaaacggcaagccgtacgctgaagcgcagggcgaagtcttatatagcgcaggctatatcgaatggtatgcggaggaagcgaagcgcatctacggaagaacggttcccgcctctgtgacgaacaagcgcatcatcgtcacacgccagggagtcggacctgttgcggcgattaccccgtggaattttccggcggcgatgatcacgagaaaagcggggccggctttggcggcgggctgtacctttat

SEQ ID NO: 186 - protein, 463 aa, Bacillus licheniformis
MGKQQMKKTMSQTDVLFLAIGAMLGWGWVVLSGDWISTAGFLGSTIAFIIGGILVILIGLTYAELSSAIPETGGGLIFVYRAFGRKTAFVAAWGVLFGYVSVITFEAVALPTVIDYVLPVEHQGFLWSLSGWDVYVTWVLIGSGGAVVLTALNYFGVKPAAIFQSVFTIAIIATGFLLLGGALVNGDFEHVQPLFKDGFSGMMSVLVMIPFLFVGFDVIPQVAAEINAPKKIIGKILIISIISAVVFYLLIVFGVTMGLSESELATTSLATADAMVNLLGNQLFGTVLVLGGVAGIITSWNAFIIGASRILFAMSEKGMVPKWFGFIHPKYKTPTNAILFLGALAFFAPLLGRPALVWIVNAGGTGIIVGYLIVSIAFMKLRKTEPDLHRPYKINKWKTTGISAILLSVIFLAFYLPGMPAALTWPYEWLILAGWTLIGFLLYNSSSKRKGEEIQHDQHARSI

SEQ ID NO: 187 - DNA, 2506 bp, Bacillus licheniformis
  CDS (501)..(1985)
ttattaccaataaatatcctagtgcagaatctattaagattacgaaaatctcaagcctgaccctgagcagcgcaaaaactgccggtcagcggccgaaaacagcagaggtgaagttttcttactttgttaaagaaaaatcaaatggctatgttctatcaaacggaaaactttcttaaaaaacagcgattatttccgtgacgacgactcaattaagatcgatgctgggcggcatgaatatgaagagcacgtatgcttctgtatccagcaatacgaacgcttttactctcagcggtaaaggattcggacacggcatcggcatgagtcagtacggatcaaatgccagagctgctgccgggcacgattacaagaagattttaagtttctactatccaaatacgactctatcaagctattaatagagtttgaacaggaagcagcagtgcctcctctgttcatgttcaggggaaaacataacatttacatttttggaggttatttttttgaaggtctttcttaaagctgtacctatgttgtggttacggttctttttgtttgtgcctaatgtatttgcggccaactctgtcacaagattggacggtgcaaaccgatatgaggttgcggtgaacgtttccaagcaggggtggacaagtgcaagcactgtgattgttgcaaatggaaaggcatatgcagacgtcctttcagcgactccatttgcctatcgaaacaacgcgcctgttctattaacggaagcgtctaaactgccaacggccactaaaaaccgaatcagtcaattaaaacctagcaaagtgatcgtaatcggcggaaccgtcagcgttcaaaacggtgtcgtaagcgagatcaaaaagcttggtgtgtcatctgtcgaacgcatcggcggagcgaatcgctacgaggttgcggcgaatattgcgaataagctgccgagcaattcgaaagctgtcatcgcaaacgggacggcctatgctgacagccttgcgatcggcgcatatgccgcgagaaacggcatcccgattcttttaacatcgtcgaattccataccgacagcgacaaaaaatgcgatgaagagcaaaggaacaacatcgaccattgtcgtaggcggtgaagtcagcatctccagcagcgtttacaaacagcttgcttctccgacgcggatcggcggcagcaaccgctatgaagtcgcggccaatgtcgtcaagaaatattattcttctgccaagaatgcaatcatcagcaacggctatgcgtatgccgacggattaacaggatctgttctggcggctaagcaaaaccgtccgatgatgttcacgaatgcatcatctttgccgacaccgacaagagaagtgatcggttccaaaaacatgacgacgtttactgtgcttggcggaacggtttctcttcaatccaatgtcgtgtcacagctgaagaatccgatcgtcggcaaaaaaatcttcattgatgcagggcacggaggtacagacagcggtgccctcggcaacggtttatatgagaaaagcgtgaaccttgatgttgcaaaattaattaatacgaaactatcaaacggcggtgctctgccaattatggcgagaacgaacgacacttacctgacgctcgcacagcgcgtgtcaaaagcgcagtcaaatcatgcggatttgtttgtcagcatccatgcaaactcggcaacgccagctgcttccggaacagaaacctactattatacaacatatgaatctgccaacagcaaacggctggcaaccgagattcaaaaccgtctctatgttgcattgaatacaaaaaaccgcggtgtaaagatcggcaacttccatgtcatcagggaatcaaaaatgccaagctgccttgttgaacttgcgtttatcagcaatgtaagcgatgcgacaaaactcaaaagctcgacttacaaagaaaaaggcgctaaagcgatttacgacggaatcgttgcttactattaaaatataaacagaaaactcgtttttcgaaaaattgcctatgctgcctttgttttgtctttattatatagtatgatatttttggtgaaattaaagataaaacggaggcggtgcatttttaacaaaaaatcaacgaatttactaattttaataactcctttacattgtgtttacgttcgtatgctacactgacgaatagatcaaacagtaacatactaatcgaggtgtatgctagtgagtatcgacaaaagtttaagaatgtacaatgaatattcaagccagcaaacttattcctgtgctctatctaaaaaagcagtacgttatttatatatgaaacggataatggatatcgtcctttccttgattgggctcgctcttacactgccgtttattctgctgttttgtatattaatctgtatcgaaacaccgggttctccgttataccggcaggaacgcgtcggaaaagacgggaagcatttcaaggtgatcaagctgcgttctatgagaattgacgcagaaaa

SEQ ID NO: 188 - protein, 495 aa, Bacillus licheniformis
LKVFLKAVPMLWLRFFLFVPNVFAANSVTRLDGANRYEVAVNVSKQGWTSASTVIVANGKAYADVLSATPFAYRNNAPVLLTEASKLPTATKNRISQLKPSKVIVIGGTVSVQNGVVSEIKKLGVSSVERIGGANRYEVAANIANKLPSNSKAVIANGTAYADSLAIGAYAARNGIPILLTSSNSIPTATKNAMKSKGTTSTIVVGGEVSISSSVYKQLASPTRIGGSNRYEVAANVVKKYYSSAKNAIISNGYAYADGLTGSVLAAKQNRPMMFTNASSLPTPTREVIGSKNMTTFTVLGGTVSLQSNVVSQLKNPIVGKKIFIDAGHGGTDSGALGNGLYEKSVNLDVAKLINTKLSNGGALPIMARTNDTYLTLAQRVSKAQSNHADLFVSIHANSATPAASGTETYYYTTYESANSKRLATEIQNRLYVALNTKNRGVKIGNFHVIRESKMPSCLVELAFISNVSDATKLKSSTYKEKGAKAIYDGIVAYY

SEQ ID NO: 189 - DNA, 2110 bp, Bacillus licheniformis
  CDS (501)..(1607)
tttggatgagacggctgatgaaatcgtcaggacgtcactgcacccgctcagagattcatcaatcgatacgctgattctcggatgtacgcattatccgattttaaaagagccgattcagcgctatatgggagagcgcgtcaacatcatttcctccggagatgaaacggccagggaagtcagcacgatcttgtcatacaacggtttattaagcaaaacggcggaaccgccggaacacttgtttttaacaactggggagcgtgcccgcttcacaaaaattgcaaacgattggtttggatacgaagtgaaaaatgtggaaagcatttctcttcaggagaccgctgtaaaataaagctgccgcacatgcaaacggcagcttttttcatggccttttcttttaaagaaaaggttttttgtattcagagggatttttttaaaaagcggtctaattcaaaaacgggctcgtatacataatagtacaaactgccttaggagggaaaagtatgctgaaaaaaggaatgaaaggaatcgcggttacggttacggcctccgcgctgcttctttccgggtgcggaatatttcagtcagatcaagcctcagaggagatagatccgccgcaggacatcacatatgtaaaagaggagaaggagcaagacaaaacagacaaaaccaaagataaaacagaagacaaaggcagcaaaacgacaagcgacgataaagccgctcaaacgggcgatacggtcatgagagagctttatctcattgataagaacggctatgtgacagcgcagacgctgccgctgccaaagcaggaagggacggctaaacaagcgcttgaatacctcgttgaaggcggccctgtttcaaacatcctgccaaacggattcagagccgtgctgccggcggatacaacggtcaatgttgatattaaagaagacggaacagcgatcgctgatttctcaaatgaatttaaaaactataaagctgaagatgagcaaaaaatcgtacaggcgattacatggacgttaacgcagtttaactcgattgataaagtgaagctccgcatgaacggccatgatttgaaagaaatgcctgttaacggcacgccgatttcagaagaactcagccgcgaggacggcattaacctcgacacggcgggtgtgacagatataacggcgacacagccggtcaccgtctattatttggctgaatcagataaaggcacatattacgttccggtgacaaagcggacgtctgcaaaagaaaaagatcaggtgacggcggcgattaaagagctgactgaaggaccggacaataaaagcggcctgctctccgatttccagggcgacgtcaagcttgaaaacaagccgaagattgaagacggccatgtaaccctcgactttaacgaagcgatctacggaagtgccgacggccagaaaaaagtgatatcggatgaagtgttaaacagtatcgtgttgacattaaccgaactgcctgatgtgaaaagtgtgtcggttaccgtgaacggaaaatccgagctcgtgaatgaaaaaggagaaaagctttccaagccggtttcaagaccgagcaaggtgaacacaggtagtttttaagccgaaatttttgatatactatagaaaaagaggtgagcgatcaaagctgcctctttctttattcagctttttggaagagcggaatgattgtgaaaggtttatgtacatacaatcggaggtaaaaaatgagatacgatggaagaaaaaacaatgaactgcgccctgtcacaatggacctcgactttattacgcatccggaaggatcggtcctgattacagtcggcgggacaaaggtgatatgcaacgcgtctgtggaagaccgcgtaccgccctttttgagaggagaagggaagggctggatcaccgcggaatacagcatgctgccgcgggccacgaaccaaaggacgatcagggaatcgtcaaaagggaaaatctccgggcggacgatggaaatccaacggctgatcggacgagctcttcgggcggttgttgatttggaaaagctcggtgagcggacgatctggatcgactgcgacgtcattcaggcggacggaggtacg

SEQ ID NO: 190 - protein, 369 aa, Bacillus licheniformis
MLKKGMKGIAVTVTASALLLSGCGIFQSDQASEEIDPPQDITYVKEEKEQDKTDKTKDKTEDKGSKTTSDDKAAQTGDTVMRELYLIDKNGYVTAQTLPLPKQEGTAKQALEYLVEGGPVSNILPNGFRAVLPADTTVNVDIKEDGTAIADFSNEFKNYKAEDEQKIVQAITWTLTQFNSIDKVKLRMNGHDLKEMPVNGTPISEELSREDGINLDTAGVTDITATQPVTVYYLAESDKGTYYVPVTKRTSAKEKDQVTAAIKELTEGPDNKSGLLSDFQGDVKLENKPKIEDGHVTLDFNEAIYGSADGQKKVISDEVLNSIVLTLTELPDVKSVSVTVNGKSELVNEKGEKLSKPVSRPSKVNTGSF

SEQ ID NO: 191 - DNA, 2169 bp, Bacillus licheniformis
  CDS (501)..(1667)
aaacgcccgctctctttaaatcgaatttacattcattataacaaaagatggaatatcaaaacaggaagggaatacagaaagaaggcaggatgatggtgaagcttttaagcataatgggctgaatttctttttttatatgggaacacggacaaaatggactctattttaaacattctgatctgttgtttttggaagcaaaatgctttcacataaccgttttttatttctttcacaagaatcgcccgcttagaaaaaccgctttttttcatgtatatgatttctaccggaatgccgtcttccatggaacgatacaacagcttattcatcgtctcacctcacattctattttatacgaacatttgttcttgatcaagtgtaaacaaaatgtaaattttggcattattcgagttcatgtatgaaaatattagcattttgaagaaactttttaaggggttattgcgtcagtaaatacgtcacatataaaagaaggagtacccgacatggcaagaacatacagaacgcgaataaagaaaagaaaaaagcagaaaacaaaaagaaggcttatcatattttcctttttggttgtttgtggattaatttatcttgcacttccaagcggtatgcgagatcaccaggaaaaccaattgcaagcaactgaaaaaaaggcacagcctgaagcaaagaaaaagccaacacaaaatgaaacaaaaaagagcaaaatcgtcacaaaaaatgataatgctcaattggatcaatatttgaaaagcattggattcagcggcacagcattgatcgtagaagatggaaaagtggtgacaagcaaagggtatttatatgcaaaccgcgaggaaatggttcccaatacaccagataccgtcttttatgtggggtcatcacaaaaagcgattattgcaacggcaattttacagctggaggaaaaaggattgctatctgtaaatgaccctgtttctaagtatcttcccaattttccaaacggctcaaagatcaccctttatcatttcttgacgcacacatccggaattaggggtcacaaagaaggccgcggatatatttcgccggaagatttaattaaagatatcgaaaaacggggtgtaaaatacccaacagggaaatgggattatagagactccaattactcggttctggcatacattgtttccatggtaagcggtgaaccagtcgaccaatacatcaaaaagcatatttttaaacctgccggtatgaaacatgcaggcttttataaaacatttgctaaagagtcaaatccatcgacaggatataaattaaacctgcaaaaaaagctttatacgcctgacatgccggatttatcacagctttacggggccggtgatatttatatgaccgcttatgacatgtatttgtttgataaagcactttacgaaagaaaaatcatttccaatgaaagttttatgaaaatgtttacgccgaataaagcaacatacggcatgggcttttatgtgtctccaggaagctattcaagccacggtgtcatgcccggctacaacatattaaacagtttcagtctgacagggagcagatacgtcattctattttcaaacatccaaaacaacattaagtcttttggcagtgtgaataatcggatcttctctattttaaatggattttgaacagcagagaaagtttttacagctaaaagggattttaattataaatgtagaagatagatgataaatgaattttcaatataaaggaaggtcgtcatgtcattattaacgcttagcaaaatcgtgaccattttataggcgttgctgcattatttatatggacttttaaagactcaaaacagcatgaacctgatacgttaaagtacgcaagttatatgttgtctcttcttgtctttgaagtcacactgaacgttttatggggataaaaataaaagcaggcatttagcctgcttttatacattcaataagtctaaaagcaaaatatcgcaaaaacaaaaaaagctttccccacaacaggagaaaccttgtcatatcaacgtattcacttaagcttccaagcgggctcgaaccgctgacctcttccttaccatggaagtgctctacctgctgagctatggaagcattggctccgcaggcaggattcgaacctgcgaccgatcgg

SEQ ID NO: 192 - protein, 389 aa, Bacillus licheniformis
MARTYRTRIKKRKKQKTKRRLIIFSFLVVCGLIYLALPSGMRDHQENQLQATEKKAQPEAKKKPTQNETKKSKIVTKNDNAQLDQYLKSIGFSGTALIVEDGKVVTSKGYLYANREEMVPNTPDTVFYVGSSQKAIIATAILQLEEKGLLSVNDPVSKYLPNFPNGSKITLYHFLTHTSGIRGHKEGRGYISPEDLIKDIEKRGVKYPTGKWDYRDSNYSVLAYIVSMVSGEPVDQYIKKHIFKPAGMKHAGFYKTFAKESNPSTGYKLNLQKKLYTPDMPDLSQLYGAGDIYMTAYDMYLFDKALYERKIISNESFMKMFTPNKATYGMGFYVSPGSYSSHGVMPGYNILNSFSLTGSRYVILFSNIQNNIKSFGSVNNRIFSILNGF

SEQ ID NO: 193 - DNA, 1492 bp, Bacillus licheniformis
  CDS (501)..(989)
gaacaccagccattcgaggcagccggcaataatcggagcgctgccgatggcgacgaccgttccgacggcgattcctgacaggctgacggctgaaaaaaagaaaggctggtaaaatgccatgctcaatgctgcgatgatcagcgttttaacgggccagccgcttcgtttcaattgaccgcggaaagccgcgaacaagagcagggtgatgccgccgacagccattctgacagcgccgaacacaagaggtgccgcctctttcggcgcaaatgcctgggttgttcccgtcgttccccataaaattgccgcaagcaagacaaacagaaccgatactttcatactaacgatctctccctactcgatcattcagaactttttctattgtaagataagtttgcggatttttgaatcgccgcttcggaaatttccctgaaaagaggaaatattcaacgctggccgaattcatataatggccaaaaaacaattaaagtcggaggaagcggatgaaaaaacgaacagttttattcttcttgttgatctggctcgccggatgtgcgagcgcccaagaggctgaggaacaaaccaaatgggtgaacagcgaacagaaagcgattgagaacggcattcgttatgaaagcattacaaaagacgatattatagacaaaatcgatttaaacggtgaacaagtcgtcgtttttcgattcggcgattcggagggagaggggattggcctcgcacacatcaaaagggaaaacggcaactatcaatggtaccgcgacttaaattacgcaattgtaaaatcggaccacccgaaaacggagaatgcggaagcttccgcgccgttcacaacccctaagggaagaaagtacacgttatatacaggggatgcagatcgcctgaatggtacatttgagactgatgacgggcttcatttggagccggtggtcgatcaaaaaacgggcatgtattatcagatcgtgcaggattcggactgaaatgaaacaaaaatgctgtcgggttgttcccgacagcatttcattttttacgatttctttttccgcactgtcaagagcagcgcagcacctccaagaagcacggcgaggatcgacaggatcagggaagcggtttgaatcccttgtcctccttgactgtcttcattttctgcggcagcgttttgtttcgttgaagcgccgtgtgcatcaaccgtttcgtgtccgagttttgcagcgtcgacaatgcttgtgattgcatgcggggtatcggcgtcatcatcaccggtccactcgacaattgtgccgtccttataatattggtatgcgttccaggcggccttttgttctttgtcagggtttttggcggtgaaggtaaactgctggaattcaccaggctgaatgccgccgttttcggcttcccacgtcacccttgttactttttcgtttttgccggtttcagtgcttgttttccaccccggcaccggttcatactgctgaaattc

SEQ ID NO: 194 - protein, 163 aa, Bacillus licheniformis
MKKRTVLFFLLIWLAGCASAQEAEEQTKWVNSEQKAIENGIRYESITKDDIIDKIDLNGEQVVVFRFGDSEGEGIGLAHIKRENGNYQWYRDLNYAIVKSDHPKTENAEASAPFTTPKGRKYTLYTGDADRLNGTFETDDGLHLEPVVDQKTGMYYQIVQDSD

SEQ ID NO: 195 - DNA, 1988 bp, Bacillus licheniformis; identical to SEQ ID NO: 35
  CDS (501)..(1490)

SEQ ID NO: 196 - protein, 330 aa, Bacillus licheniformis
MKKLLVVYAVMLCLFFLYVYDYSRGDKAGSAEESRRPAAAGSLSEKYVMVTFQSGIEYWKSGLKGFEDAAQLFNVSVEYRGAAHYDVHEQTTVLEQVIAKKPAGIAVSAINPKALNPVIDKAHEQGIPIVLFDSDAPLSKASTYIGTNNMEAGAVAARRMAEFLNGKGETAVITQPQQYNHQERTKGFEQTIKQKYPNMKVAAVLDGKGDELTSKKEAAKILEENPSIKGIFTTEANGASGVARAVKEAGLEGEVCIIGFDKDKKTLDGIKNGSISATMSQDTWQMGYWSLHMLFFSNHHLKHERPLPAAIDTGITIITKENVAAYYAND

SEQ ID NO: 197 - DNA, 1677 bp, Bacillus licheniformis
  CDS (501)..(1190)
tgcgctgtgctgtttcgcaaacttgtcttctgtggcgattatgcttggatgacttggaagaatggcgccgtaccggcgttcctatatcggcgtctcagcttgaaagacgtgctgctcgaacattggccaaccttttaacgcagctatcgcccgaatgtgtatcggatacatgataacccagcgtaaagataggaaggggcgagtgcgggggggggggctggggggggccgggggggcgtcggtggggggggacagggcaggggcagttggtagcgcgtggtggaggtgggccggggccgatgtggggggtgcgcgctgtcgggggcaatgcgtcattgtaagtgagtgaatttggttgcgggggcaggatttgagcctgggacttcgggttatagccggacgagctgccgaactgcaccaggctgttgagtaccagggtggtatgaaatgttcagcccttttgcccaataagaaaaaataaaactgggagcgagaagatgatgaaacgaatctgtgccatatgctggggatccttgctgacgctggcgttcagcggcaatgctgaagcgatttccaacaaggcgatccattggggtttttcaaaaagcaaaaaccatcagccggcagatgcgggtcaagagctgaccaaccttttacagcagtacgacgccttttatttgggcaacacaaaggaaaaaacgatctatctgacctttgataacggctatgaaaacggctacacccctcaggtgctcgatgttctgaaaaaacaaaacgtcaaagcggccttttttgtgacgggccattttgtcaaagatcagccggagctgatcaagcgaatggccgaggaggggcatatcatcgggaatcattcatatcaccatccggatctgacgacgaaaacaagccgcgtcattcaagaggaattggaatcggtcgatgaggaggtttacaaaatcacaggcgaaaaaaacaacctctacctgagaccgcctcggggcattttcagcgagcgggtgctcgaagaaacgaaaaagctcggctatcaaacggtattctggtctgttgcttttgtcgattggaaaatcaatgcccaaaaagggtggcgctatgcgtacgacaatatgatgaaacaggctcaccccggcgccatctatctgcttcacaccgtcttcaggcgatcaccgacttgaaaaaagaaggttatacatttaaaagcctcgatgacctgatgtttgaaaaatctatgatgcttgagacccttgaaagaacaatgcccgggtgccgaggtcgcaatgcgtaaaacatttgtttttcccccccccgaagaccccgtctcaaataatataaaatagatataaaaaaaaagaatcataataaaaaaagaatatctatccccaccaaagggagggtggttttgataaccagtcgcagtcgggggaaagtgctcaaccatggaaaaggggtgtgttttatcattaggcaggtgtgtgacaaaggcggtaaaatacagcgaagcatccaatgttttattaaaagctattagcaggatggcaaagtgcatctcgctgttcaagactttggagggggcatcgattcaaaaagatatgccgcgcgtgttgacaaaggctttacatcaacaacggagcatcatgatcaggccgccacgggaatggg

SEQ ID NO: 198 - protein, 230 aa, Bacillus licheniformis
MKRICAICWGSLLTLAFSGNAEAISNKAIHWGFSKSKNHQPADAGQELTNLLQQYDAFYLGNTKEKTIYLTFDNGYENGYTPQVLDVLKKQNVKAAFFVTGHFVKDQPELIKRMAEEGHIIGNHSYHHPDLTTKTSRVIQEELESVDEEVYKITGEKNNLYLRPPRGIFSERVLEETKKLGYQTVFWSVAFVDWKINAQKGWRYAYDNMMKQAHPGAIYLLHTVFRRSPT

SEQ ID NO: 199 - DNA, 4041 bp, Bacillus licheniformis
  CDS (501)..(3641)
aagaaggaaaagccgaattaaagcttggccatgccgaacaaattccttatccggatcgttcttttcataaagtattttcagtccacaccatttatttttggacggatttcaaacaggcattaaaagaaatttaccgtgttttacaggttgacggcacgctgtttctcgctgtgcatctggaagggcaaatgaaaaaatcgaaaaaaacaaaaggcttttccttatactcagaagagcaaatcaagcaactgcttgaggaaagccatttcagagacatcacggtacatatgaacaaaaattactgctgcatttctgcggtaaaatcatgaactttgtatgatcatccctttcaatacggaagggattttttatgtttgatagagttgaaactggatcttaaatatcatatttttgatttttaaagaaaagtattccattaacatagcaaacatggtttaatatcaaagtgaacgtttttactatattttccggaggtatttatgaacaaaaggatcgtgaaaagttcaattgttttctttctccttgccgcattaatttttggccagctgcctttaccgaagacaatggcagcggaagacagcgttccgaataacgaaaccacattgaccagcgcgtcccctgttgaagcttcgtttcaaagcgatgacgaggtgcattggtataaagtcaatccttcaaatcaggaaatcgcaaactatacgcacttccgcgtcaaattgaaatcagatgcagagctgaacatttccgtctactccagcctggaaaatgcaactggtcatcaaacgtttgaccgatacaacggctactcctatgaaaataatcctgctttaatcgattttccgattgcctggaaaggtccttactacataaaagtagaaaatcaccatgatgaggaaaacgaaaccacttcaattacagatatttcttacaccatcagctatgaaggcgtcaccctgcctccgtcaatccaagaggcagaagaagagtgtccggcagaattaagcgtttccgaaagggaaacaggcaagggcatattaaaacagttaagaacgatcagggatgaagttctttcaaaaactgaaaaaggaaaagagctgtcttccctttactataaagcagctccattcatcagcgcaaaaatgctctttaacaaatcgatgagagacagtgtctacaaagacctggtgcagctgaagccgctgtttgcagatgtcgctaaaaacggacaagtgagcgcatactcgattacgaatgatgatcaaaaagcgatcagtcgcctgtacgaaacagctcgcgcgtccgttcccgagccgttgaaaaaacagctggatcaagtcgcgaaagacatcggcatcgaacaattaacaggcagcaaagtatcggctgtgcttgaaaaagcggggatggcgacagcttcatcaagcgcgcccgaaaaccgttacatcgtaaaattgaaagaaggcaaaaaaccgggatctttcaaatctaaagcccaatcatccggcgtccaggcattagagcccctcggtaaaagcaaaacggcatttaaagatatgtacgttgtggaaatgaaggaaagccgttcttccggattcaaagcggcggcaaagcaatatcaggcggcagcctccaagatcgccaagatgcctgaagtggaattcgtcgaacaggttcagcaatatgaagcactgtcaagagacacccaatatccatatcaatggtcgctcaaaaataacggcaaaaaccgtgctgcgaatgctgacatacaatttgaacagcttcagaagctgatgaaaggcaaaaagctgaaagatacagtaatcgccgtcgttgacacaggcgttgatcatacccttgcggatttaagcggcagcgtcaaaaaagacgaaggctataactatgtcggccgcacggcggatgcgatggatgacaatggccacggcacacacgtgtcaggcatcattgcagccgcgcaagacaaccatttttcgatggcgggaatcaatgcttatgccaaaattctgcctgtcaaagtgctggattcttcaggcagtggagatacggaacagattgcaaacggcatcatctatgccgccgaccacggtgcaaaagtcatcaatttaagtcttggcgggccatacagccgggtgatggaatatgcgcttaaatatgcggcttctaaaaatgtgacgatcgttgccgccaccggaaatgacggagtatcggagatttcctaccctgcatcttcgaaatatacgctttcagtcggggcgaccaataatctcgatcttgtctcggactactccaattatggaaaaggtctcgatatggtggcgccgggaaccgatattccaagcctcgttccggacgggaatgtcacttatatgagcggaacatcgatggcggcgccgcacgtggcagctgcagcaggacttcttttgtcacagaatccgtccttgaaaccaaagcaaatcgcaagcctattgaccgagacgacagcagatgtggcatttgaagagcaggataatccaaacccggattatgacctggatatagaaccggctgcacaaattcccggatatgacttcgtctccgggtggggaaggctgaatgtttttcatgcagccagcgtttttgagctgaacatgaaggttcatcccgttttaaaccgccatacggcagtgacaggcacagccaaaagcggtgtgacggtcaaaatcttgcgagggaagcaagtattggggacgggcacggccggaaaatcaggcgcgttttcagtgaaaattccggcccagaaggcggggcaagttcttcatgtcgcggcatcgggccatcaggcggaaacctcgctcagaaccgtcgtggaaaaagcgccgaaaaacccgtccgtcaaacgcatcacgaacaaagatactgccgtaacgggtagaacggcagccggctacacgatcaaagtgaaaaacgcgtgcaaaaaagtgatcgcgcaaggcagagcggatgcatccgtgagcgttaaagtgaaaatcaacaagcaaaaagaatatgccgttttgtatgtctccgcatctgctgatgaccacagagaaagcggcgatgtcaaaatgacggtggctgacgtcatcccgccaggcgccccgaaagtttatcaggtttccgataaaagtacggtgattcagggaaaaacagaagcaaacgcgcaagtcagcgcaaaagctaaaggaaagacgatcgcttccggcaaagcgaacggaaaaggtgaatacaagctgaaaatcagcaggcaaaaagccggaaccgtcatcggtgtaacagcaaaggataaagccggaaatgtcagcaaagcgacagccgtcactgtgcttgacaaaaccccgccgtctgcgccgaaggtgaatccggtgacaaacaagagcacggccgttaaggggaaagcagaagcgaacgccgccatcatcgtcaaatcaggaaagaaaacgatcggaaccggcaaggccgataaaaaaggcgcgttttttgtcaaaataaaaaaacaaaaggcaaacaccgttttagcggtcactgcaaaagataaagccggcaatacgagcaaagtgagcaaaataaaagtcaaaaaggcaaaataatccgatagcggaggaactgatgacatatcagttcctctttttttcatcaaaattaatatataagaatattattaaatctgcactgtctgttttcaatttgtgattttcagctcatatcgccaattggtcctattatcccttttttcattttcccttaaaaatttttatattaaaaaaggaatcttcgggtgttctgtcaaaaagtgaatgtattggaaacagcggaatgaacgttcattccgctgacttggagggcaaaatcaatggaatcggaaagcaaatatcagaagattatcgaggcttcgctcgtcctttcgcggacagaggctttgacgccgcaaccattcccatgatcgccgataaggcaaacgtcggtgcaggcaccatctaccgctac

SEQ ID NO: 200 - protein, 1047 aa, Bacillus licheniformis
MNKRIVKSSIVFFLLAALIFGQLPLPKTMAAEDSVPNNETTLTSASPVEASFQSDDEVHWYKVNPSNQEIANYTHFRVKLKSDAELNISVYSSLENATGHQTFDRYNGYSYENNPALIDFPIAWKGPYYIKVENHHDEENETTSITDISYTISYEGVTLPPSIQEAEEECPAELSVSERETGKGILKQLRTIRDEVLSKTEKGKELSSLYYKAAPFISAKMLFNKSMRDSVYKDLVQLKPLFADVAKNGQVSAYSITNDDQKAISRLYETARASVPEPLKKQLDQVAKDIGIEQLTGSKVSAVLEKAGMATASSSAPENRYIVKLKEGKKPGSFKSKAQSSGVQALEPLGKSKTAFKDMYVVEMKESRSSGFKAAAKQYQAAASKIAKMPEVEFVEQVQQYEALSRDTQYPYQWSLKNNGKNRAANADIQFEQLQKLMKGKKLKDTVIAVVDTGVDHTLADLSGSVKKDEGYNYVGRTADAMDDNGHGTHVSGIIAAAQDNHFSMAGINAYAKILPVKVLDSSGSGDTEQIANGIIYAADHGAKVINLSLGGPYSRVMEYALKYAASKNVTIVAATGNDGVSEISYPASSKYTLSVGATNNLDLVSDYSNYGKGLDMVAPGTDIPSLVPDGNVTYMSGTSMAAPHVAAAAGLLLSQNPSLKPKQIASLLTETTADVAFEEQDNPNPDYDLDIEPAAQIPGYDFVSGWGRLNVFHAASVFELNMKVHPVLNRHTAVTGTAKSGVTVKILRGKQVLGTGTAGKSGAFSVKIPAQKAGQVLHVAASGHQAETSLRTVVEKAPKNPSVKRITNKDTAVTGRTAAGYTIKVKNACKKVIAQGRADASVSVKVKINKQKEYAVLYVSASADDHRESGDVKMTVADVIPPGAPKVYQVSDKSTVIQGKTEANAQVSAKAKGKTIASGKANGKGEYKLKISRQKAGTVIGVTAKDKAGNVSKATAVTVLDKTPPSAPKVNPVTNKSTAVKGKAEANAAIIVKSGKKTIGTGKADKKGAFFVKIKKQKANTVLAVTAKDKAGNTSKVSKIKVKKAK

SEQ ID NO: 201 - DNA, 31 bp, Artificial sequence
  Primer EcoRI <L12 574-594>
gactgaattcgtgcgagttcctccacattcg

SEQ ID NO: 202 - DNA, 39 bp, Artificial sequence
  Primer HindIII BglII <L12 1074-1052>
gactaagcttagatctactctataagttagtttgtcacc

SEQ ID NO: 203 - DNA, 43 bp, Artificial sequence
  Primer KpnI BglII BamHI <L12 1500-1520>
gactggtaccagatctggatccgaaaacggttgctgtcaacgg

SEQ ID NO: 204 - DNA, 32 bp, Artificial sequence
  HindIII <L12 2007-1986>
gactaagcttatcttttgtggagatgctttgg

SEQ ID NO: 205 - DNA, 1399 bp, Bacillus licheniformis
  misc_feature (255)..(255): n is a, c, g, or t
  misc_feature (257)..(257): n is a, c, g, or t
  CDS (501)..(899)
ctttctttgtcacgaccgtcacacgctgcgccagcatgacctggctccaccagcctccgaccgtctgaaagcggagatagcccctgtcatcgatccgcgtaaccataaaaccgacctcatcaagatggccggcaatcataatcttcggtccgtcagcctgtccagtcttttttgcgattaagcttcccagtctgtctgtcgtaacctcgtcggcaaacggttctatgtacgatttcatgacttgtctgggttctntntcattcgccggaattccttttgcatcagttaattccttagcatcatcaatgtttcatcaagctttgccatctttatacagcctctttaattaaccctcatttactattatacagaaacatcccttttcaatacgaccaatatcgtttacagcttttttggttaaaaaatgaaaccttgcgggaactggttcgtatatattgggatatactcaaaattactttcaagggaggttctgttttaacatgattgtcatcatattgagactggctttgctggcgcttttggtctacgtcgtgtacagggccgttcaatttttggggagcccggacagaaggctgaaatcagcacaggcaaaaaagcacttttatgttttggacgaacaaaagaatacacgcaaaaatctcaagctgacatttaaaggcgtgcttttcgaaggagaaaaacacattccttcaaaagaccatccgctgttcatccatacgatttttgtatggacggaagcgcctgaagaaaagctcagctcttttacggaagaagacttcgcggaacttgaagaaaatattaaagagcactatcccgattgcaaaatcgactgggattcgaacatccaaaagtggaaaaacaaaaaagcagaagagcaataaagcctcgtctgcttttttaattcatcatataaaagccggtcaaaacagcttgcacgccgagcaaaaaaggaatgccgagcctgaaggaaaggtgttttgtcttatgtctgaaccgcatcatcccgaaccagacgcctgcggagccaaaagcagccgcaacgagccagatgcggcgctcagacaccctccatttgcctctgaccgctttttgcttatcggctttcattaagaaaaaaccgtatccgtttatgaggatcatgtatatccatatgagagtcaattgttcatttccccttgtttttcggtttgggcgcctgctgcggccggcctccccgaatcgttttacatcctgctcgaagaacaaaagaaaaaggccggagcccggccttttttcaattatttattcaattgcgctttagcagcgtctgcaagctgattgaatgcgttcagatcgtttacagcaaggtcagcaagcattttgcggtttacttcgatac

SEQ ID NO: 206 - protein, 133 aa, Bacillus licheniformis
MIVIILRLALLALLVYVVYRAVQFLGSPDRRLKSAQAKKHFYVLDEQKNTRKNLKLTFKGVLFEGEKHIPSKDHPLFIHTIFVWTEAPEEKLSSFTEEDFAELEENIKEHYPDCKIDWDSNIQKWKNKKAEEQ

SEQ ID NO: 207 - DNA, 2182 bp, Bacillus licheniformis
  CDS (501)..(1682)
aaaaaacattaattttcatactgatatttggtattatctttttaacagcacttcttgcgggagcgaatgtctaccgtacggcaatggatcagaaagaaaacggccacgagcaggctgccgaaacagccaggcaggaagccggcttaaaacaagttgacagcgtggagacgtttgtcggtaaagaaaagcagtacattgttacaggggcagacaaaaaaggcgacaaaatgtatgtttgggtgcctgctgacaaaaagcagaaaacgctttacaaaaaagcatcagccggcattaccggccgccaggctgcaaaagctgttcaggatgagggcctgatgtctgagcttaaagaggtgcaccttgcaagggaaggcaatgttctattgtgggaagttacatacttaaataaagatgggcagtacagtttaagctatgtggactttataaacggaaaaattcacaaaaatattacgccttagacgaaacagggggaaatcgagttgaatctagctaaaagagtatcagcgttaacaccatctgcaacattggcaatcactgcaaaagcaaaagaattaaaagcggcagggcacgacgtcatcggtcttggggcaggtgagccggattttaatacgcctgagcacatcattgaagcggctgtccgttcgatgaacgaaggacataccaaatacacgccttccggcggtcttgcggcgctgaaagacagcatccgcgataaattcaagcgcgatcagggaattgaatacagccaatcggaagttattgtgtgcacaggtgcaaagcatgctctttacaccctatttcaagtgctcctcgacgaaggggacgaagtgattattccgactccgtactgggtcagctatcctgaacaagtcaagcttgcaggcggcaaacctgtgtttgtggaaggccttgaggaaaacagcttcaagatttctccggagcagctcgaaaaagccgtcacagaaaaaacgaaggctgtgatcatcaattccccaagcaatccgacagggatgatgtatacggaagaagagctcaaagctctcggtgaagtatgccttcgacgcaacgttttaatcgtatctgatgaaatatatgaaaagctgatttacggcggaaaaaaacatgtatccattgcacagctttctccagaacttaaaaaccaaaccgtgatcatcaacggggtttccaagtcacacagcatgaccggctggagaatcggttatgcagcaggcagcgaaccgatcattaaagcgatgacgaacctagccagccacagcacgtcaaatccgacatctgtcgctcaatatggagccattgccgcttacaatgggccaaacgagcctgttgaggagatgagaaaagcttttgaagaacggctgaacaaggtgtatgaactgcttgttgacattccgggattaacatgcctgaagcctgaaggagccttctacttgttcccgaatgcaaaaaaagcggcagaatcgtgcggcttttcaagcgttgatgaattcgccgaagcgcttttggaagaagaaaaggttgcgatcgttcctggttcagggttcggcgcaccggacaacatccgtctgtcgtatgcgacatccctgtcacttttggaagaagcggttgaacgcatccgccgctttgtcgtgaatcgcagccgctagaaattaaaaagcgtccgcaggcggacgcttttttcatgcacacaacctgcattgacctgatcgatttaaaaaaggtataatatacgttatggacgtcagaaagaatgatggcttgaccgaattctttcgtgttttggagggaaacgatagtgaaaacaacaataaaccaagtgtacaagcatgttggtgaagaagtaacaatcggcgcttggatcgccaacaaacgttcaagcggcaaaattgcgtttttgcagcttagagacgggacaggctttatccaaggagtcgtcgtcaaagcggaagtggacgaagaaacatttcaaaccgctaagtctgtaacacaggaaacatcattatatgtaaaaggcgtcgtcaaagaagacgagcgttcgcctctcggctacgagcttgctgtgacgtcgcttgaagtcatccatgaagcgacagattatccgattacacctaaagaacacggaacagaatttttgatggatcac

SEQ ID NO: 208 - protein, 394 aa, Bacillus licheniformis
LNLAKRVSALTPSATLAITAKAKELKAAGHDVIGLGAGEPDFNTPEHIIEAAVRSMNEGHTKYTPSGGLAALKDSIRDKFKRDQGIEYSQSEVIVCTGAKHALYTLFQVLLDEGDEVIIPTPYWVSYPEQVKLAGGKPVFVEGLEENSFKISPEQLEKAVTEKTKAVIINSPSNPTGMMYTEEELKALGEVCLRRNVLIVSDEIYEKLIYGGKKHVSIAQLSPELKNQTVIINGVSKSHSMTGWRIGYAAGSEPIIKAMTNLASHSTSNPTSVAQYGAIAAYNGPNEPVEEMRKAFEERLNKVYELLVDIPGLTCLKPEGAFYLFPNAKKAAESCGFSSVDEFAEALLEEEKVAIVPGSGFGAPDNIRLSYATSLSLLEEAVERIRRFVVNRSR

SEQ ID NO: 209 - DNA, 1663 bp, Bacillus licheniformis
  CDS (501)..(1163)
taaggaggaatcaggatgactgcattgtttacagcaaaagtcacggcaaaaggcggaagatccggacatgtcaaatcagatgacggggttttggaccataacattgtcatgccaaatgaaaaaaaagaaggcgaatcagggacaaatcctgaacagctctttgcggcgggatacgcggcgtgcttcggcggcgcattggaacatgtcgcaaaacaaaaaggcattgacatcgattctgaggtcgaaggccatgtgagcttgctgaaggatgagagtgacggcggttttaaaatcggcgtcaagctgatcgtcacagcaggcggggtagaaaaagaaaaagcgaaagagctggtcgaagccgctcatgacttttgcccttattcaaaagcgacgagaggaaatatcgacgtcaatcttgaagtaaaataaataaacgggaaagatgaaaacgagaaagcaaacaaagcttgtttgctttcttttttagaaaggagcagcatatggcatatcttaaaaaagcgcttgtgttctccgtgctttctctcgctattgtccttgcaggatgcggaaccggagcggcggagaagaacaacggcaatcaatccccggctgatacggccaagcagaaagcacctgatttgaaaacatattcccttgacaaaaatatccggtctgaagaagattttgatttgataggcaagtatgttcatgctgaagatgaccaaatcacgctcgaaataaaggataaggaactgattgttccgaaaagcagccgctttcacagcgaagaagaccatgatgacttaatcgggaagcttgtgaaggtagaggtggatggaaaaacgcaagaagcggaagaagccgagcttatgccgcagtcaaaagccgaccaaaatggcgtatatgaggaggagaaagacggcagccgaaaaatcatcgccacgtttgtcagcgagtcggagcaaaacattacaatcaaaacaaaagcaggggaaaaaacttatcagaaaacagccgattttgagagggatgtcgccgaagcacctgaaaaactgaaagggaaaattgtcaggcttgaaattgaaaaggatggaaaagcagaaagccttgatttggaatcggaagatcaaaagcttgaatggtatgagccgtctgcttcaaaataaaaaaagcttcctgatgaaggaagctttttttaatattccactttttgatcggtcttttcccatgtgagaaaaggttcaagctttgcttgaaggtccattttataaaaaggaattttccgttcgcttttcgttttggtgatttcttcataaataaaagagtcgtcaaaaccggccgatgcggcatccgaatgctgagcggcgaagtaaacttccttcggtctcgcccagtagatggctcccaggcacatggggcacggttcacagcttgtataaagaatgcagtcgttcagctgataatcgccaagtgcttcacaggcgagccgaatagccgttacttccgcgtgcgcggttggatcattgcttgttgtgacattgttttttccctcggcgataatttggccgtctttgactatcacagcgccaaaaggtccgcctgtgccgcttttcacgctctccaccgcaaggtcgatggcgcgctgcaaaaatgcttcatgatt

SEQ ID NO: 210 - protein, 221 aa, Bacillus licheniformis
MAYLKKALVFSVLSLAIVLAGCGTGAAEKNNGNQSPADTAKQKAPDLKTYSLDKNIRSEEDFDLIGKYVHAEDDQITLEIKDKELIVPKSSRFHSEEDHDDLIGKLVKVEVDGKTQEAEEAELMPQSKADQNGVYEEEKDGSRKIIATFVSESEQNITIKTKAGEKTYQKTADFERDVAEAPEKLKGKIVRLEIEKDGKAESLDLESEDQKLEWYEPSASK

SEQ ID NO: 211 - DNA, 2161 bp, Bacillus licheniformis
  CDS (501)..(1661)
caaaaagaaaagggtctttttatacggggccaagcaggaggttattcaagctgttgcagatcggctttcaaccgaatatcccggaattgagctggccggatactcacacggctatgtcaaagacaaaggcgaagttgcgaagcaaatcgcggctgccaagccggacatggtttttgtcgctctcggatatcctcatcaggaaaagtttatttatgaacataagcatctatttcctcaggcgattgcgatcggcatcggcgggagcttcgacgtgttcagcggaaaagtgaaaagggcgccgaaaatgttcatcaagctgaatcttgaatggatgtaccgcctgctgaccaatccgacaaggtggaagcgcatgctgaacatcccgaaatatgtcttctccgttctgaaagaggaaagagttcaaaaacagcggcactactatccggagcagatcaaagagcaatctaaaatcgatttgtagaaaagagtttgggtaacgaatgaatatacgttctttattggttatggtttactcggccggtctcgctttgaccggttttattttcagattggtaaaagcgcgcgacagagctgtattgcttgtttcctttccggataatgcgcgcgcgctgcttgatgagtatgtcagcagcagccggccgtttgaaatggaagtcctctatacaaggcacgccgtttcccttgcagatgaatatccttccgttcgatcgcaagtgatcaacgagaaaaatccgattcatctcataaaagccgtataccgaatgttcaggtgtaaattcgtgttgacggataattattttctgctgacaagtgttttgaataaacgccctcagacgacatgcattcaaatttggcatgcgtccggcgctttgaagaagttcggactcgaagatatcggaaaccgctatcgatccgccggcgatatcaaacggtttaaaaaagtgtatcgttcatttgatcatatcgttgtcggctcggaaaaaatggcggatattttcaagcggtcattcggcttgggagatgaccgttttttgcggacgggtgttccgttaactgatgagtattttcatgccggaagacaaacagcggagcgtccggaccaaaaggttattctgtatgcgccgacatacagggactattgtttgacgtccgttcgtctccctttctctaaggagcagctctccggggaactgcagggagaatttttgctgctggtcaaactgcatccggccgtgcgggaacagattgcttttgaagagcacgaagggctgatcaaagacgtatcagacgttccgttaaaggatttgctgatggaaagcgacatcctgatttccgactactcgtcggtcgcctttgagtacgctttgttaaataaaccgattttgtttttcacgtatgatatggcagagtataatgaaaaacgcggactgatcgatgattttgaagcagtcattcccggcaaagcctgcatggacagcgaaatgctgctgaaagaaatcaaagaaatgtccgatacaaaggaagagatcaagaagtttgcggaagagtggcatcaatattcaacaggtgatgccagcatgcgcctgttgaactttatgagcgagcatatgacggcaaatgaaaaaagaccggccggttcctaatggaacatggccggtctttttatgatgattaccgataaaccggcacatcatagtacagcgtatattgatcgagcaatgtatacagactgtacattctccccacctgcttacaagcccatccgacatctgtcgcatattggtgaagggcattcggagaccatctcattttatagagggtgtcctgtttgtaagtcgggtggtgaatgtatttttcaccgatgaatttggctccgcccataatggcggcctcaggtgtgaaccacccttgttcataggcgtattttgcgccgtagtaaagcgggttgctgtcgtaagccccgacgccgtacatattgtaaacctttttgccgttgaacatcgttcctttagccaactcggaagttccgttgcccgtctcaaggagcgagtgtgaaatgaggtacagttcattgatgctgtatgctctcgccgcgtcgatgaacgcttgccctttgcctgtcaaaacccctttattataa

SEQ ID NO: 212 - protein, 387 aa, Bacillus licheniformis
MNIRSLLVMVYSAGLALTGFIFRLVKARDRAVLLVSFPDNARALLDEYVSSSRPFEMEVLYTRHAVSLADEYPSVRSQVINEKNPIHLIKAVYRMFRCKFVLTDNYFLLTSVLNKRPQTTCIQIWHASGALKKFGLEDIGNRYRSAGDIKRFKKVYRSFDHIVVGSEKMADIFKRSFGLGDDRFLRTGVPLTDEYFHAGRQTAERPDQKVILYAPTYRDYCLTSVRLPFSKEQLSGELQGEFLLLVKLHPAVREQIAFEEHEGLIKDVSDVPLKDLLMESDILISDYSSVAFEYALLNKPILFFTYDMAEYNEKRGLIDDFEAVIPGKACMDSEMLLKEIKEMSDTKEEIKKFAEEWHQYSTGDASMRLLNFMSEHMTANEKRPAGS

SEQ ID NO: 213 - DNA, 3106 bp, Bacillus licheniformis
  CDS (501)..(2606)
gatattcagtttgcccgcgagatcagttacatttatggaatgaacggttttgacttgtacttgctgctgctctttagcgtctgcgtgctgaacgccgctgaatgtgaagagcgttgctgcagctgctgctgataaaagaaaagcttttttcataaacagtaatcctcctaaatgttgtagtagttgttgtttcgtacactagaatcataacatggcttttttgaaataatagatccatatattccctttgacaaggtattattgttaattttgacataaaaaaagaaaaaccctttgctgccaatatgcaaccagatcgttcttttacacgtcttgtcataaacgtggtaaaatttaaatttgttagttaaattttaatataaaaagagattgacagcttttttgaaaactttagattgtaacaaccattacaaaagtgttacaatatatctcagttaattaatgtaaaattgaatattgtgagaggagagagagtttcagtgacagaatctcaacatgatccggctgaaatcaaaaagagcaggcgttcgcgtttatggcggatcaacctgtacttctttgcggtgttcactttgttcgctgcgctgattgtcaagctgggcctcgtgcaaatcgtcaatggagaggcgtatgagcaggaagcttcgaaaaccgaggcgaaaattgcgtcatacccggcaccgcggggtaaaatgtatgacagatacgggcgggtggttgtcgacaaccaaagcgttcccgcgatcacatatacgatgatgactagcacaaaaacggaggaaaaaatcagcacagccaaaaaactcgcagaattgatcgatatcgatacttcgtttctgaaagagagagatctgaaagattactggcttgccagacacccgaaaaaagctgctgcacttctgaaagacagcgagaaaaccctcaagtctgatcaaacatacaagcttcaggtggaccgcgttccggcggaagagatcaaagcgctggaaaaggacaaagatgagcttaaagtcgcagcgattttcagaagattttctggcggctatgcgtatgagccgcaaatcgtcaaggcgatgagcccgaaaaccgcggggaaaaacgatgcgcagctccttgatgagaaggcttctaaacagatgccggccaacgatttgacgtatgaggaagtctcacgcgtttccgagcatcttgaggaactgcccggcgtcgacgtcatcatggactggaccaggaaatatccttatgaaaaaacgctctactccattttcggaggcgtcacaacgcctgaacaagggcttatcaaggaccgggaagacttttacctgacaaggggatatgcccggaatgacagagtgggaaaaagctatctcgagtatcaatatgaagaatatttaaatccgaaaaaagcgaaagtccaatataccgaaaaccgttcaggaaaggttatcagccaggaaacggttgatgaaggaagacgcggctacgatctgcagctgacgttcgacatggagctccaaaagaaagtcgaagaggctatcgaagaggagcttaataaattccgcggctcaaactacatgctggacagagcgttcgtcgtcatgatggacccgaataacggagacattctgtccatggccggaaagcggatcgtcgacggcaaaatcaccgactatgcaatcggcgcgtttacaacccagtacgaaatgggatcggcggtcaaaggcgcgaccgtgcttgccggctatcaggacggcatgccgcatgggcagagttatttagaccaagagctgagcttcgcagggggagttaaaaaaggttcctacagaggaaacactatcggttgggctaatgaagttagagcgctggaaaaaagttcaaacgtttatatgttctatgtggcaatgagaatggcaggaattacgtatgtaccgaacggcccgcttccggcgaacctagaggacttaaagaaaatgaggtattacttcaatcaatttggccttggggtaaaaacaggcatcgacttgccgcaggagtcggccgggatgcagacaaacccaaaaatagtcgggggtctcctcctcgatgaagcgatcggccagtttgacacgtacacgcctttgcagctcgcccaatatgtttcaacgatcgccaacggcggatacaggttgcagccgagagtcgtgaaaagcattcaccagccagaaagcgaaaaactcggtccggtcattgaagagcgctctgccaatgtgctgaatcgtatcaacaattctcaaagcgacatcgccatcgtcaagcaaggatttaaacgagtaacccagacgggaactgcagccggcgcattcggttcgcttgacgtatcaggcaaaaccggaacggcgcagacgcaatactacggcacaaaccgaaactggtgggggactaggacttacaatatcacctttgccggctattacccgtcggaaaatccgcaggtcgccttcagcgttgtcgtcccgaatgtcgacgacaaaacgaagatgaacaaaaacatcgccgccaaaatcgtcaaagcctatgtcgatctgcaaaaaaaatacagcaaagattagacaaaaaagaacacggattttttccgggttctttttttgttatcaaaatttgacgaatgctagaagttttgaaggagatttctcgcattttagcgaatccttttaagcaaaatagttttaatgaatgctggtcatgaatagggtataaaggagggatatgatggaacaaaaaacaaaacgttttgagcaatataagcctcatatgaatttacaggcagtcctgtcagctaacggccgttttatatacatatctgcaaattgcaaagagctcttaagctacgagcagaatgaactgatcggtacgtatttgaaggactatttacacgaagacgatctttttctggtagaaagctatttttacaatgagcatcatttgctgccctgcaccttcagatttgtgaaaaaagactacacgatgatctggatcgaagcatcgatcgatttcgtgacgacccatgttggagaaaaagaacgcgaaattgtactcaaaatgaaag

SEQ ID NO: 214 - protein, 702 aa, Bacillus licheniformis
VTESQHDPAEIKKSRRSRLWRINLYFFAVFTLFAALIVKLGLVQIVNGEAYEQEASKTEAKIASYPAPRGKMYDRYGRVVVDNQSVPAITYTMMTSTKTEEKISTAKKLAELIDIDTSFLKERDLKDYWLARHPKKAAALLKDSEKTLKSDQTYKLQVDRVPAEEIKALEKDKDELKVAAIFRRFSGGYAYEPQIVKAMSPKTAGKNDAQLLDEKASKQMPANDLTYEEVSRVSEHLEELPGVDVIMDWTRKYPYEKTLYSIFGGVTTPEQGLIKDREDFYLTRGYARNDRVGKSYLEYQYEEYLNPKKAKVQYTENRSGKVISQETVDEGRRGYDLQLTFDMELQKKVEEAIEEELNKFRGSNYMLDRAFVVMMDPNNGDILSMAGKRIVDGKITDYAIGAFTTQYEMGSAVKGATVLAGYQDGMPHGQSYLDQELSFAGGVKKGSYRGNTIGWANEVRALEKSSNVYMFYVAMRMAGITYVPNGPLPANLEDLKKMRYYFNQFGLGVKTGIDLPQESAGMQTNPKIVGGLLLDEAIGQFDTYTPLQLAQYVSTIANGGYRLQPRVVKSIHQPESEKLGPVIEERSANVLNRINNSQSDIAIVKQGFKRVTQTGTAAGAFGSLDVSGKTGTAQTQYYGTNRNWWGTRTYNITFAGYYPSENPQVAFSVVVPNVDDKTKMNKNIAAKIVKAYVDLQKKYSKD

SEQ ID NO: 215 - DNA, 1489 bp, Bacillus licheniformis
  CDS (501)..(989)
atcaaaaccagctttgagaccccagcgcccctatatcgggacatatagcggagtgctatggcgccgccggttgaatgaccggcaagcgtgaagttgtttaattgaagcgcctcaacgacagcgcggatatcatcagccaaacggttgtaattatagcccgtcgccggcttatccgaacgcccgaatccacgccagtcaatgccgatacagcggtatccctttcgcgaaagatcgtcaaattgatattcaaactggagatggcttaatggccagccgtgcaaaaatacaatggctttgccgctttgaggattgatgtcttcaacgtacagattaacgcttggttctgcctcgataaaatatcccatgccgtcgcccccgatcatgtctttaccataagatactcccaagatgtaaataggtgaatgtctccgagggctgaacatgaagaatttgaaaaggcgtgactggttaaactatttcaagaaacggagggttgttcaatgatggcacttctgagaagtctggcgatatcgtttgtcctcattctgcctgcggcagcggcctacgcacaagtaccttatccatgcagcgtcgttcttgatccagtccgagatattcccaatgcccgcggaacggctttaattgcgaaagtgaagaaaccgtataccgaagcccccgggagtcctgtcagggaaaggcagagtgtcggcatctacgctgattggcttccggaccctgcttcatttggagattatgatcaatttgaaggaattgcccggatacctgaccagatcagctggcgtttcaccatgcatcaagtccaagaagacgcgccgagctggtttggcggaagtccttgggcgggcaaatttgacgaaatatcatcagagctgactgtgaatacccaagtcgaagtgcgccctttcaattcgaagacgaaaaaggccggcgaagctgttttgcgtgggaatttgcaaggatgcaggagctaaccaaaaaggccgtaaaagctccatggggacgcttctacggccttttttcatgtgaagaattttttcttccggaaaggttagtatttttcgtagcgatcgcaaggtttaccgcagtaagagtggtcatgataaaccggcttatagcttgaataagagtgcggataatagtgaacatgttcgtatttatgatgatccacttttttaatatgctgcggatggatgtgaggaacgatcgttttagagaatctgtgatcctcacagtatctagtaggatgcacaactggcggcagaacgcgcggtttgcagtaagacataagcacttctcccttccttaggtttcattcttcactatcagattatgttgattagcacaaacttgtactaatacaagaaactaaaaatccgtccattttccccgcctttttgctaaaaagtgtttctcagatgctataataataaaaatactattgaaaatggagctggacagatggacgcga

SEQ ID NO: 216 - protein, 163 aa, Bacillus licheniformis
MMALLRSLAISFVLILPAAAAYAQVPYPCSVVLDPVRDIPNARGTALIAKVKKPYTEAPGSPVRERQSVGIYADWLPDPASFGDYDQFEGIARIPDQISWRFTMHQVQEDAPSWFGGSPWAGKFDEISSELTVNTQVEVRPFNSKTKKAGEAVLRGNLQGCRS

SEQ ID NO: 217 - DNA, 5296 bp, Bacillus licheniformis
  CDS (501)..(4796)
gggccttcgccatatgacgaaatcaagcccgatatttctgcacctggcgtcagcatccgctctgcttatccgggacataagtatgctgcaatgaacgggacatcgatggcgaccccgcatgtatccggcatcgtcgccttaatgagggaagccaatccggacctcacagtcgatgaaatcgagcgcatcctgctgaaaacggcgacgcctctgactgacaaaacgtttaaaaaatccccgaacaacggctacggatacggcttggtcaacgctttaaaagcttttgacgcagctaaaaaaactaaatgataaaaaaggacaaaacctttaagcggttttgtcctttttttatctaattttaaacaaggccttgacaaataccgacaaaataattaaccagtttttactatatttaagttacatcaaagtcagacaaggcgtccacaaggagggggggacaggaaaattcagctaatttcataaaaaagggggatgttcatttgaaaagaaagctgagaaaaaaggcgttttccaccattttaagcggtttgttaatcggctcgctgttcatgcccgccgtttcagatgccgcggcaaagcccgcacttacttccatgaaagaacaagcagccgcagggaaggggaaaatttcaaaaactcttgtcaaacagttcaaaaaagaagatcaagtcacatttttgattaaactgaaagatcaagtcgatacaccaaaagtggccaaacaggcggaaaagaacgcgaagaaaaagtcgctgagcgctgctaaaacagaatatcaaaaacgctcggctgttgtttccgctttaagagtcaaagcggatgagtcgcaaagcgatctgaaacgttatttaaaaaagcaggaaaaacagggggacgtaaaaaaaatcagatcctattatattgtcaacggcatggccgtccatgcgacgaaagaggtcatggaacaagtagcggcttttccggaagtagaaaaagtgcttccgaacgaaaaaaggcagctgatcaaaccgactaaacagtctgtgaaaaaatcagcagccaaggatgaaaaagaaatcgaatggaatatcaatcgagtcgacgcaccaaaagcctggaaattgggatatgacggatcgggcacggttgtcgcgtcgattgatacgggcgtgcagtgggatcatccggccttgaaagaaaaataccgcggatatgacccgcagcatcccgatcagcctaaccacgaattcagttggtatgatgcggtttcaggcgcttctgaaccatttgacgatctggagcacggcacgcatgtaaccgggacgatggtcggctcagagcctgacggccaaaaccaaatcggcgtggcgccgggtgcgaagtggattgctgtgaaagctttttcagatgacggcggtacggacgaagaccttattgcagcaggtgaatggattttggcgccaaaagataaagacggcaacccgcaccctgaaatggcgccggatgtcgtcaataactcatggtcagggggagccgggattgatgagttttacagggatatcgtaaaagcgtggcgagctgccggcatctttcctgagttctctgcggggaacgtcgatttcgccaatccgggaggacctgcttcgattgccaatccggcaaactaccctgaagcgttcgcaaccggagcgacagacatcgataatcgcttagccgatttttcacttcaaggtccttccccgtatgatgagactaagcctgaaatatcggcgcctggtgtcaacattcgctcatctgtgcctggaagcggctatcaagacggctgggacggcacttcaatggctggcccgcatgtcgcagccgccgccgctcttatcaagcaagccgattcgtcgatcactgttgatgagaccgaaaagattttgatggaaactgcaacaccgctcacagacagcaaatttaccgaatcgccgaacaacggatacggccacggactcgtgaacgtgtttgacgcagtgtccgctgtgacagacgggttgggcagagcggaaggacaagtcggaaaagaaggcgaagacaaaagtccgccggccttaaaccatcaagagatcaccgaaatttactcaggctcggaaacgcctcttaaagctgatgtagaagacgatgtcagcatcatatcggtcaaattgagctataaaacagatgacgccgattgggagacgatcgctgccaaacaaacttccggcgactataaaaaaggaacgtacgaggcggctgtaactgtttctgaagggaaaaccctttcctacaagtggattgtcaccgatttcggaggcaacaaaacggaatccaaagtgtacgaagtcccgatttccccggctgtgacaacagggtataaacaagatttcgagaattccgccagcggctggctcacatcaggcgtgaagaattcatgggagcgcggaattcctcagtcaggcccgaacgccgcagcatcgggaaaaaacgtattcgcaacaaatctgacagggccgtatgaaagttcggctaatatgaatcttctcatgcctcctgtcagcgttccaaaaaatcaaaagctttatctcacatacaaatattggcgcgatattgaagaggactttgattacggcttcgtttacgtacagcctgaaggaaaaggtgaatggatcccggctgccgagtacagcggcaagacatcagaatggaaagacggacagatcgatttgtcggaatacgggggacagacgattaaggtcatgttcaaccttcaatctgacgacagcattgaaggtgacgggctgtacatcgatgatgtagcgcttgtcaaggaagtgaagagcgccggtacgaaaaaacgattgggcgttgaaaaacagccggccaaaatgaaggataagaaaacaaagaaacgaatgattgatccgaaaaaagcaaaaccggcagaagcccttcaggaaaaaaccgaaacgaaaaaagcagctcctgcggttcttccggtgcgcgctcaggtcagcgtgctggaaacgggcaaatcgacatattccaaccaggcaacaggcgcatacagcttggctcatgcacctggaacctatacgctgaaagcggaagcgtacggatatgaatcaaccgcccaaaccgtaaaaatcgagtccgacaagacaacaacggcagactttgttttaaaagaactaaaaaaagggacgctcaccggaacgataaaaaataaaaaaacgggcgaacccgtccggcatgcaaagttgtatatcgttgaagatgcagctgtaaaaccagtccagacggatgatgacggaagctattcattaacggcctatgaaggctcgtatacggtaaaggtctctgcaaacggatattacagcagcgagttttccgttgatttaaaaggcgatgtctcgaaagatatcgatctcgatcctttcatcggctatccgggggaaataggctatgatgacggaaccggggaaaacgcctgggctttctatgaatccggcaacgggctggcggttaaaatgacgcttgaaaacgggcaggaaaaagccatgctgaaaggcggtttgtttaaattctgggatacagaattccctgatccgggcggcactgattttgcagtagaggtctatgatgcttcgggtgaaaaaggctctccgggcaaaaaaatcgccggcccgttcaaggctgaagcgctccgcacaggcgaatggacgaccgttgatttaggtgacgaaggcatcatcgtcggaaaagacttttacctcgtatacgtccagaaagaggatctggccaactcacctggacttgctacagacgaagacggagaatattccggccgcaactggcagtatacggacggctcatggtcaaaagcgccatcagaccaaggcaactttatgatccgcgctttggtcgactatgaattgtcggtgcctgtgattacgtctcctaaagacggattcatcaccaaccaaaagaacgctgtcattgaagggacatcctcgccgaatacgaccgttcatctctttaacggggatgaagaagccggaacagcggaaacggcggcagacggcactttctcaaaagaaataccgttgaataaaggggaaaatgtcatcaccgcgaaatcgtcatcggcttccggaacgactgatgcttcagaaccggtccggatcgtccttgaccagaaaaagccgaagcttacaatcgacacgccggaaagcggctcaaaactcaataaagagaccgtcaccgtgaaaggaacagtatcagacgatcacttagaatctgttcatgtaaacggcaaaaaagcagctgttgacaatggcgaatattctgcaaggattatgcttgacaacggcaaaaatgaaatcaaagtaacggcatcggatgcggcaggcaacaaaacgaccaaaaaggtcacggtagatgtcaactttgaagcgccgcaaatcaccggcttgaaaccggccgaagatctcgagctcaaaacgggagaaaccgtgaaaatcgagtttgaaagcgccgctgatttggatgctgtctttgtgatcagaatgccgctgaccaatttcaaaaccgctgcccaaaacgtaacggagctgccgatcagagaagtctcaaaaggaaaatatgaaggatattggaccgctacttcaactgcaaaagcaaaaggagcggaaatcgaggtcatcgtcagagatgattacggcaatgaaacgagacaaacggcaaaaggcaagctgtatatcaatgaaaagctgaaataaaggtgaaaagacgctgtctttaatggcagcgtttttttcgttttacgatcgacaaattcagtacgaaaacttcaaaaaatgtacgatttacgcaacattaattgacagactttacctttgggcttgatttatacttaggaaaacaaacactaaggtcaccgagccgcagaaaggggaaggatgtggaaatctatttagatgcgatatggctgttaaacttttgttttgacttgctgcttttaatgatgaccgcatttattttaaagcgaagggttaaaaagcggaggctgatcctaggggcatttgtcgcgtcaagcatcgttctgtttatgtttacacctttttcaccgtacgtccttcatcctgccggcaaactgtcgttttcggttgtgatcgttcttgtggcatttggttttaagcggttccggttttttttgcagaatttgttttctttttattttgccacttttttaatgggaggagggattatcggagcg

SEQ ID NO: 218 - protein, 1432 aa, Bacillus licheniformis
LKRKLRKKAFSTILSGLLIGSLFMPAVSDAAAKPALTSMKEQAAAGKGKISKTLVKQFKKEDQVTFLIKLKDQVDTPKVAKQAEKNAKKKSLSAAKTEYQKRSAVVSALRVKADESQSDLKRYLKKQEKQGDVKKIRSYYIVNGMAVHATKEVMEQVAAFPEVEKVLPNEKRQLIKPTKQSVKKSAAKDEKEIEWNINRVDAPKAWKLGYDGSGTVVASIDTGVQWDHPALKEKYRGYDPQHPDQPNHEFSWYDAVSGASEPFDDLEHGTHVTGTMVGSEPDGQNQIGVAPGAKWIAVKAFSDDGGTDEDLIAAGEWILAPKDKDGNPHPEMAPDVVNNSWSGGAGIDEFYRDIVKAWRAAGIFPEFSAGNVDFANPGGPASIANPANYPEAFATGATDIDNRLADFSLQGPSPYDETKPEISAPGVNIRSSVPGSGYQDGWDGTSMAGPHVAAAAALIKQADSSITVDETEKILMETATPLTDSKFTESPNNGYGHGLVNVFDAVSAVTDGLGRAEGQVGKEGEDKSPPALNHQEITEIYSGSETPLKADVEDDVSIISVKLSYKTDDADWETIAAKQTSGDYKKGTYEAAVTVSEGKTLSYKWIVTDFGGNKTESKVYEVPISPAVTTGYKQDFENSASGWLTSGVKNSWERGIPQSGPNAAASGKNVFATNLTGPYESSANMNLLMPPVSVPKNQKLYLTYKYWRDIEEDFDYGFVYVQPEGKGEWIPAAEYSGKTSEWKDGQIDLSEYGGQTIKVMFNLQSDDSIEGDGLYIDDVALVKEVKSAGTKKRLGVEKQPAKMKDKKTKKRMIDPKKAKPAEALQEKTETKKAAPAVLPVRAQVSVLETGKSTYSNQATGAYSLAHAPGTYTLKAEAYGYESTAQTVKIESDKTTTADFVLKELKKGTLTGTIKNKKTGEPVRHAKLYIVEDAAVKPVQTDDDGSYSLTAYEGSYTVKVSANGYYSSEFSVDLKGDVSKDIDLDPFIGYPGEIGYDDGTGENAWAFYESGNGLAVKMTLENGQEKAMLKGGLFKFWDTEFPDPGGTDFAVEVYDASGEKGSPGKKIAGPFKAEALRTGEWTTVDLGDEGIIVGKDFYLVYVQKEDLANSPGLATDEDGEYSGRNWQYTDGSWSKAPSDQGNFMIRALVDYELSVPVITSPKDGFITNQKNAVIEGTSSPNTTVHLFNGDEEAGTAETAADGTFSKEIPLNKGENVITAKSSSASGTTDASEPVRIVLDQKKPKLTIDTPESGSKLNKETVTVKGTVSDDHLESVHVNGKKAAVDNGEYSARIMLDNGKNEIKVTASDAAGNKTTKKVTVDVNFEAPQITGLKPAEDLELKTGETVKIEFESAADLDAVFVIRMPLTNFKTAAQNVTELPIREVSKGKYEGYWTATSTAKAKGAEIEVIVRDDYGNETRQTAKGKLYINEKLK

SEQ ID NO: 219 - DNA, 2092 bp, Bacillus licheniformis
  CDS (501)..(1592)
cgtgtgctggtagaataaaaagcaatcgcgcttcggctgttcgctaaaggcttgatcggcctgtccgccggtaaaacacggcttcatcccatagctgaataaatgccacaaaaaatggctcaccaagatcgcgtccctttccggaagctccatgcttgcggcaaaacggttttcccacgtttttctcaagtaagagccccacttcggtatttctgtcactttcacattttgtctttcaagcttgctgatgatgtacattcaggccctccgtttattttatttttccaagcgctagcacacccgctagttctcttctacatttccccttttaaaaatcaatacgaaaatcctgctattgatggaaaaacattttattattggacttacgtcctgtttttggatagtccaaaaagatcaaataaatctagcaatctccattttttcatttataataaataagtcaaaatcattactcaaaaaaacattcggggtgatctatcgtgaaagcacccgtgaggtatatatggattggtatgatcctgtgctttttatccgtcagtctggccgtcggctgcatcaaagctgaagatcagtcagatgatgagaaaaatgatgaagcgcttcagcctgccgaacacttcgtttaccgtcatttaatgagcgatcaggggctgatcaaaaccggcttttccgaccagcctgtttacttgtcggaatcgcttggcttgtggatggagtttttgatcagcaaaaaagacggcgagcatttccatgagcaatatcagcacctgaacgaatccttccttatgaacaacaacctggtgtcatggcaaatccaaaacggccaggcaagcggggtgaacgccctgatcgatgatctcagaatcatggtgagcctcgatcaagcggcagctctatggggaaacagcgagtataaacaaaccgctcggaacatcggtgccgcattaagaaaatacaacatgaacaacgggatattgacggacttttacgactccgcctctcaatccgcggcaaaagatatcacgctttcctatatcatgccggatgcgctatccatcttgaaaaagaatggagtgataaataaagaactcgaaagtcggaatgccagcattctttatctcgcccctttgaaaaacggttttctcccaaaagcatacagtacagaaacgaaagcatacacctatgaccatgaagtcaatctcattgatcagctttacgcagcttggcatttacctccgaaggatcaaaaagccgctgtattagcggattggctcaaacagacgtttcaaaccggcggaaaactgtatggccggtattcgctcgatacaaaaaagccggcggtccaatacgagtctccatccgtctacgcgttggcgattttattcttcatcaaccaaaacgaagataaaaccgtcattaaagcgctgtatgatcgaatgaatgattttgaaattcttgattcgtccgagacgtattatgggggatatatgagcggaaatgatacgcattcttttgataatctgctgcccctattagccgaaaggaagcttttaaatgaaaatctcattcaatgaatcgcataaaatgttcgcttatatgacaggacttgcagcagcgcttgcgttgttcatccattatatctcagtccagcggttcgaacccgttctcatcatttgcatcacacttgccatcatcgcagcaggaatatggctcggatcgatttacgcactggctgggaccatcatcgtcctgtttgttctcggcactttgatgatgttttttcacacaggccaaggagaagctgcttcgtctgaaaccggactgcaaatgctcgtcatctggggagtggcgctgttgctgttttcctttatgtcagggagaatacacgacatcgcgatcggacttcaccgctccgtcaaacaccttcaagacgaaatcaaaagctttgttgcgattgacagggtgacaggctttgataataaacagaggatgaagctggagctgtcagaagaaatcaagcgggcggagcggtatggcaactcgtttgtttttttactgcttcatatgcatt

SEQ ID NO: 220 - protein, 364 aa, Bacillus licheniformis
VKAPVRYIWIGMILCFLSVSLAVGCIKAEDQSDDEKNDEALQPAEHFVYRHLMSDQGLIKTGFSDQPVYLSESLGLWMEFLISKKDGEHFHEQYQHLNESFLMNNNLVSWQIQNGQASGVNALIDDLRIMVSLDQAAALWGNSEYKQTARNIGAALRKYNMNNGILTDFYDSASQSAAKDITLSYIMPDALSILKKNGVINKELESRNASILYLAPLKNGFLPKAYSTETKAYTYDHEVNLIDQLYAAWHLPPKDQKAAVLADWLKQTFQTGGKLYGRYSLDTKKPAVQYESPSVYALAILFFINQNEDKTVIKALYDRMNDFEILDSSETYYGGYMSGNDTHSFDNLLPLLAERKLLNENLIQ

SEQ ID NO: 221 - DNA, 1420 bp, Bacillus licheniformis
  CDS (501)..(920)
gacgattgaagcagccagacagaagtatccggaacgggacattgttgcagtatttcaaccgcatacatttacgcgcacgcagtcattcctgaatgagtttgccgaaagcctcaagaaagccgattatgtatatctttgcgatatattcggatctgcccgggaaaacgcaggaaagctgacgatcggtgatttgcaggagaaaattccgcaggcgaagctgatcgatgaaaatgacacatcaattttaaaggagcatgaaaatgcggtgttaattttcatgggcgcaggtgacattcaaaagtatttaagagcatatgaaaatgtattagcataacaagaaaaaggcagtgtgagtcaatccgctgcttttttgtacatatgaagcgggagtttctgttaaaggaattcacccgtgcgtatagaaaaagtaaatatagaggtttacgatttaaacaattgggtatacatcaattgtaagcccttagctgaaggaggataagatgattattattctgtatttaagcgctgcactcatcgctgttagctttcttattttggttatctatttatcaaaaacattaaaatcgcttcaagtcacacttaatcatgttgcatcaacgctggaaggtgtggaaggacaaatgaaaggcatcaccgctgaaacaacggagctcctgaataagacgaatcggctcgctgatgatattcaggaaaaatctttgaagctgaatacggtcgtggatgccgttcaggaagtcggcacatcggtcaggcagtttaacaactccattcagcaggtttcacagtccgtcacatcagccgcagagcaaaaccgtgaaaaaatttctcaagttgtcagctggagcaatgcagctttggaaatttggaatagatggaaacaaaagaagatgagggaggaataataaatgagtaaagacggaatgaatactaaggattttttaatcggcacgtttgtaggcggaatcatcggggcggctgcagctttattttttagcgccgaagtcggggaaagagcttcgcgatgaccttggaaatcaggccgtcgttttaaaggataagaccggaaagctcacaagcgaagcgagggagagaggctctgagtacgtcagcatcgccaaagagaagacatcttcgatttcacagcttgttgccgaccagtcttcacagattatggataaagtcaaagacttgcgaagcaagggtgccgaaaaagctggtgaactaaaggaagaagcatcgtctgcaatcgaagaacaggctgaagaagccaaaaatgaaatagaagatgaagcaaggaaaacagcagataccgctcagaaataactgtggaaagggagatcaccgtgtcgaaacagctcattcaaacagaggatgaatttaaaaggcttgcagaaaacaa

SEQ ID NO: 222 - protein, 140 aa, Bacillus licheniformis
MIIILYLSAALIAVSFLILVIYLSKTLKSLQVTLNHVASTLEGVEGQMKGITAETTELLNKTNRLADDIQEKSLKLNTVVDAVQEVGTSVRQFNNSIQQVSQSVTSAAEQNREKISQVVSWSNAALEIWNRWKQKKMREE

SEQ ID NO: 223 - DNA, 2641 bp, Bacillus licheniformis
  CDS (501)..(2141)
accggggcatgtttcgcttttccggcagtcggacagaaccttgatcgcaggggacgccgttacaactgttgagcaggagtctctatttgaagtggcaattcaaaagcaggagctgaacggaccgccggcttatttcacaatggattggacaaaagcagcagattcggttcggaagctggcaggattaaaaccggctgcattattgacgggacacggtgtaccgatgaaaggaagcgatttttccgaagcgctccttgatctatcagaccgcttgcccgcctctgattcgtaaattgtcatatgctgcgcttaaaacattcagccaggctgaatgtttttttatagggaaaaactaaccattttacatgtgatgatggccgtccattgttctaaattccggatgttgatgtataccaaaggaatcattttctgaaattttagacaaaatatgttgatatttcatttataatgcaggtatgcctgaaaggagctgagaaaagatgaaaattcaaaaaagggtccaagctttgctggcaacttcggcaatgtttgcaggactgatgctgtccgatgcggtgtacgctgcggaaaccccttactatggaaagaactatactcagccagagcaagtgtcatcattatatccggagcctgaagaaacattctcaacccctgcttttgtaaaagaaggggaagcctttacgacacaagaagaaatgatgaagtttataaccagtctgacaaagaaaagcccgaatgtcaaaatcgggaatatcggtttttcaattgaaaaaagaaatattcctgtgctttacttcacaaaggacaagcaaatacgttccatatcaaaaaaaccaaccgtctggctgcaaggacagatacatggaaatgagccggcagcgggagaatctgctctggcgatagctgaaaaactggccggaccgtatggcgacaaagtgttggacaagatcaatgtcatcgttgttccgcgggtcaatcctgacggatcatatcagttcaacagacggctggcgaacggaatcgacggaaacagggatcatgtcaagctcgagtctccagaagtgcgcgccattcaccaagaattcaataagtattcgcctgaagtcgttatcgatgcccatgaatacggtgtcggccaaaacgaatttcagagcataggcgaaaaagggtcattaaaataccatgatattttaattttatcaggaaaaaatttaaacattcccaagtcgatcaggcatgcgtccgacagcctttatgtgaacggcgtcagagctaaacttgatgaaaaaggattttctaatgatgcttattatacgacaggaaaaagcaaggacggaaaaatcgaaatctatgaaggcggtacagaagcgagaatcgggcgtaatgcattcgccctccagcctgccctttccttcctggtggaaagcaggggaatagacatcggacgcgaaaattttgcaagaagagtcgcggctcaggttgctacacatgagacgatcatcgacacgacagtgaagcatgcagccgagatcaagcgccttgtctccaaagaaaaattaaagctgatacaaaacggcgctaaagtgagcgataaagaccaagtggtcatcaacagtgagtttgcaggcccgtttaaagacacgcttaaagtcgctgatattgcctcaggacaagcagttgacgttcctgtccaatattacagcgcctcagaggccgttcctgtgctgtcaagaactcggccgaccgcttaccttgtccttccgggccatcaagatatcgaacagaagctgaaggatcagggattaaagagcgtgacactggctttcaaacaaaaactcaccgctgaagcgtatgaggttttatcgaaagaaacagcgggagaatctgagggccggccagtgatcaaggtagaaacgaagctcaaaaaacagaaaaaagagtttcctaaaggaacaaaaatctattttacagctcagcagcaaagcaatctgctgtcaatcgcacttgagccggagtcggttgacagttatgtaagcacaggttacattccttctcaaaaaggcaaagagctgccggtttaccgcttcatgctgaacaccaaaacgcttaattttaaggaataatcaccaggcatccgtctttgacggatgctttttagcggttttttgttttttcatacataattgttttaaactgagatcgaaacctatacaataaatatcagtctgaaatctggaaggagagaatccggttggaatcacatgaagaattatggagggaagccaaggccttcatcgagctctgctacggggaactgtcgaagtccgaagaagaaacaaggatgcgcttacataaaatagataaagaaatcagagaaaccggaagctatacacatacattagaagaaatcgaacatggagccagaatggcgtggagaaacagcagccgctgcatcggcaggctgttttggcactctcttactgtcatcgatcaaagaggcgttcaaaccgaggcagaggtgcgggatgcgcttttccaccatattcagcttgcaacaaacggagggaaaatcagaccgttcattacggttttccccccggaacaaaacggacaaaaaaaa

SEQ ID NO: 224 - protein, 547 aa, Bacillus licheniformis; identical to SEQ ID NO: 166

SEQ ID NO: 225 - DNA, 1381 bp, Bacillus licheniformis
  CDS (501)..(881)
ttgattattattttaagtaatcgcagaaagaaaggtcggtctatggcaagctatttaaaatccagaatcgtatcttatctgtttattcttttggaagtggggaccggattcgcaatttgcgaggtgtcaatggaaaatccgaattactcctcagcttgcgcggtctttatcataggttttacgattggggaatgcttcatgattagaaaatggtaaattttgatcatgacgggatactctttaccctcttctataaaagtgggacagacagttgaaaagccggtaaattcatagccttgtatttcaacagtaacttcttctatatgcgggtttcattttttcatctttgcttaatacattaaatcacctcctttatacagtatttgtccattaaagaagaacaggatcttcttgtcaaatatctttattagatcatattgtcatgtataatgaagggtatagcatgtgacattcatactgtataagaaaggatatgaccagtgaaaatgttgaaaaaggctgtgttgatagccgctgttttcttgctggccgcatttgccgggagtacagaagcctttgctatgccttccaaaggcgcggtgaaattcaggacggatgccaatacatatacgaaatcagccacttcgatcgttgtcactggaaaaagccctgttacgggaacgatgattgccgtcaggctgatcaataaaaaagggactgtcctgatctatcgagatgttcatttaacgcgcggaaagcctcattttcgggtgagctttccgacgaaaaagctgaaaccgggcaagtatgacgtctgggtggatgccgtcaaaggaaagaagtggcacggggaattgaagcgctacattgtcatcaagcattgatctcttttatgatggacggagggctgtgtaatgactgtcgtgggtttttgcgtattattatgttctgcatttatccatgcatcgtggaactatctttctaaaaaagccgatggaggcgttccgtttatctggctgttcacagcgattgcagccgtcatctacacgccgttggccataggtgtcgtcatatatgaaaagcctgagatcggcatctggcagcttgtcatcatcatggcgagcatccttgctcacttgggcttttttcttgttcttcaaaaaggatacaaaaagggcgatctctcccttgtctatccgatcgcgagggggacaggcccgctgctcacctgcatgctggcggtcgccttttttggcgagacgttgacgctgcccgctattatagggattctattgattgtgatcagcattcttttttttacagggggagtgaagcggttaaaagaatcaggctcgttcacaccggttctttacgggctggc

SEQ ID NO: 226 - protein, 127 aa, Bacillus licheniformis
VKMLKKAVLIAAVFLLAAFAGSTEAFAMPSKGAVKFRTDANTYTKSATSIVVTGKSPVTGTMIAVRLINKKGTVLIYRDVHLTRGKPHFRVSFPTKKLKPGKYDVWVDAVKGKKWHGELKRYIVIKH

SEQ ID NO: 227 - DNA, 1687 bp, Bacillus licheniformis
  CDS (501)..(1187)
caatgtcaatgaaatgaaagacccgtttttgaaaaaaggcctgctccttgccatcgacggatgggatgaggagacgatccgcaatgtgatgaactcggaaattgccgcgatggaagaacgacacagaaaggggagaaggatctttgaaaaagcaggagaatttgcgcctgcatggggaatgatcggaacgcttgtcggtctcgtcatgatgctcaaaaacctgaacaagccggaaacgctcggtccgaatatggcaatcgcccttttgacgacgctttacggatcacttttagccaacatgctgtttataccgatcgccgcgaagcttgaagaaaagacggagaatgaaatctttaagaagcaagtcatgatcgaaggcatcatcggcatccaatcgggaagaaatccgcgaaatcttgaaagtcagcttgtcgttttcagttcaaaagaagaatggacaaaaaagcgggcggaccgcatgaaacaaaaggacaggcctcatgaagcttagacatgaacgaaggaagcgcgagcagggccgcaaatcgccaaactggatcatcacgttttcggatttgattacgctcatcctcgtgttctttattttactgttttcgatgtcgcaaatcgatttaaacaaattcaaagcagcagtcggttcatttcaagacagggccgacggcaaatccgccgcagagttgaaaaaagacgcgggcgatcagaaggctgaaaaaacggctaaaagccaagatgatttattaaagaaaatcaatgactatattgaaaaaaacgaactgtcaagtttgattgcggccaagcgtgacgaacggggcgtcattctcgtccttcaggaagcggttttgtttgattcagggaaagcggatctgaaagaccaagctcacccgcttttgcataaaatcgccgtccttctcaaatcggtgtccaacccgattcgtgtggaggggcatacggacagccgcccgatttcgacttaccgttttccatccaattgggagctttctgcagcaagggcgagcactgtgatcggctactttacgtcgaaggaaaagctcgactcgtcgcgttttcttgccatcggttatgcggatacaaaaccggtcagggacaaccgcactgagagccatatgaaggaaaacaggcgcgtcgagattgtcatcgcaaaacaataatgagaagaaagcaaggtcttgcacaaaagcaaggccttttctgtgtgccgcaattttcatattaagtggtacgctgggcagagcgaatcggataaagggctttggcaacggtttgtgcgtttttttccgttatttcggtttttcttggaattggaggatacaaatcttccgggtcggaccagttggcaggaagccggacagatgcctgtttcccccattttttcagccatttttcaggcattttctcctctggttccatccctttcatttcaagccagattcttgcccatgccctcggtacgacgcgccaaatgtcgtagccgcctccgccgacagcgatccatcttccgctgcaataggtgtgtgcaagttcgtgagcgagctttggaatctcttcgtaaatcttcatcgtcgtgcacaagtgtgtcagcggatcgtagtaatgtgcgtcagctccgttttgcgacaaaatgacatccggtttgaaaaactcggct

SEQ ID NO: 228 - protein, 229 aa, Bacillus licheniformis
MKLRHERRKREQGRKSPNWIITFSDLITLILVFFILLFSMSQIDLNKFKAAVGSFQDRADGKSAAELKKDAGDQKAEKTAKSQDDLLKKINDYIEKNELSSLIAAKRDERGVILVLQEAVLFDSGKADLKDQAHPLLHKIAVLLKSVSNPIRVEGHTDSRPISTYRFPSNWELSAARASTVIGYFTSKEKLDSSRFLAIGYADTKPVRDNRTESHMKENRRVEIVIAKQ

SEQ ID NO: 229 - DNA, 2602 bp, Bacillus licheniformis
  CDS (501)..(2102)
tatctgattgccccaaaagcgatattcccgttgattttgattttgtcggtcgccggggggcaggcgattcttgaaacgtttgtcggtgtcgccacaaaacttgtcggctttttctccgatttaaagaagtaaaccattccaagcggatggttttatttttttgtcaataaagtgatacaaacagcagagagaacgtgtcagttttatgaacttttcacagcgatttttcccggatgcggcattttaggcagagaggaagcatctcattgtaaagatttcagtttttaaaatttagaattgagagaaaaaggatgtgcaaagtccccggccatttgttttaaaagcttgcggtcactagtattcagacctcccattttatacgaaaagaggaaatagatagattttttaagcgccaaaaaacaagaaatatggttgatagacaatcggtgaatagtttatttacaatcagttcgtgctacaggcaaggaaaggagtgaaaaatggctgcggaaaaagtattttcgaaaaataaaatcattggaggaaaaagaatgtcatatatgaaacgttccatctctgtcttcatcgcctgttttatggtagcggcgcttggcatcagcggtatcattgcaccgaaagcggctgccgcttctaaaacacccgttgctgtaaacggacagcttaccttaaaaggtacgcagctcgtcaatcaaaacggaaaagcggttcagctgaaaggaatcagctcccacggtctacagtggtatggcgattatgtcaacaaagactcgttaaaatggctgagagacgactggggcatcaatgtcttccgcgcggccatgtatacagctgaaggcggctatattgacaatccgtcggttaaaaacaaagtgaaggaagccgtcgaagcggcaaaagaactcggaatctatgtgatcattgactggcacatactgagcgatggcaatccaaaccaaaacaaagcgaaagcaaaagaattttttaacgaaatgtcaagactttatggcaagacgccaaacgtcatttttgaaattgccaacgagccgaacggcgatgtcaactggaatcgcgacattaaaccttacgccgaagaaatcctgtccgtgattcgcaaaaactctccgaaaaatattgtgattgtcggaacaggcacctggagccaggatgtcaatgatgcggcggacaatcagctgaaagacggcaatgtcatgtacgcgctccatttttatgcgggcacgcacggtcagtctttgcgggataaagccgattatgcactcagcaaaggagcgccgattttcgtcacagaatggggaacgagcgatgcttcaggaaacggcggggtctaccttgaccaatccagggagtggctgaaatatttagacagcaaaaaaatcagctgggtaaactggaacttatccgacaaacaagagtcgtcagcagctttaaacccaggcgcctctaaaaacggaggatggtcgcaatccgacttgtccccatcaggcaaattcgtcagggataacatccgcagcgggtcaaacggttcgtcaggagactctggatcgaattcgaaagggtcagatcaaaaagaccaaaaaaaggatcaggataaaccaggtcaagacagcggcgctgcagccaacacgatagcagtacaatacagagcgggggacaacaatgtaaacggcaaccaaatccgccctcagctcaacattaaaaacaacagcaaaaaaaccgtgtctttaaatcgaatcactgtccgctactggtataaaacgaatcgcaaaggacaaaattttgactgcgactatgcccaaatcggctgcagcaaaatcacgcacaaattcgttcaattaaaaaaagcggtaaacggagcagacacgtatcttgaagtaggatttaaaaatggtacattggcgccgggggctgatactggcgaaatccagatccgtcttcacaatgacggctggagcaattatgcccaaagcggcgactattcattttttaattcaaacacgtttaaaaatacgaaaaaaatcacgttgtatgagaacggaaagctgatttggggcactgaacctaaataacggcactttgacggacaccggatatggtgtccgttttcgtatatattataatggaaggaatgaggaatatttttgtaaacatgaaaggagatggatgtatgaatgaaacattgcagcaatacatgatgcttgtcaaggaacactatgacacgatcaatggaccggattacacaggcaaggaggaagacattgaaaagagaaaggaacaaatcgagctttacgccaaaacgcttcagcaaggcttttcaacagatgatgactatgatgaattcgcagatgccgtgattaaatgcgcatacggagatctgacggtggaagaattagaaacggtttatcgggaattaacgtctccataatcaataaaataagggggaggagaagcatgaaagacatgatcatgaagacagaccggcttattttgcgaaaaatgaggcgcgatgacgccgaaaacctgctcgaaatcttttctgacccgatagcaatggaatattatccat

SEQ ID NO: 230 - protein, 534 aa, Bacillus licheniformis
MAAEKVFSKNKIIGGKRMSYMKRSISVFIACFMVAALGISGIIAPKAAAASKTPVAVNGQLTLKGTQLVNQNGKAVQLKGISSHGLQWYGDYVNKDSLKWLRDDWGINVFRAAMYTAEGGYIDNPSVKNKVKEAVEAAKELGIYVIIDWHILSDGNPNQNKAKAKEFFNEMSRLYGKTPNVIFEIANEPNGDVNWNRDIKPYAEEILSVIRKNSPKNIVIVGTGTWSQDVNDAADNQLKDGNVMYALHFYAGTHGQSLRDKADYALSKGAPIFVTEWGTSDASGNGGVYLDQSREWLKYLDSKKISWVNWNLSDKQESSAALNPGASKNGGWSQSDLSPSGKFVRDNIRSGSNGSSGDSGSNSKGSDQKDQKKDQDKPGQDSGAAANTIAVQYRAGDNNVNGNQIRPQLNIKNNSKKTVSLNRITVRYWYKTNRKGQNFDCDYAQIGCSKITHKFVQLKKAVNGADTYLEVGFKNGTLAPGADTGEIQIRLHNDGWSNYAQSGDYSFFNSNTFKNTKKITLYENGKLIWGTEPK

SEQ ID NO: 231 - DNA, 2437 bp, Bacillus licheniformis
  CDS (501)..(1937)
cagccccgagctcaaaaccgagcacctggtctgattccgtatcctttgccgtcagcataataatcggaaccgtgctctcttctctgacctttttgcagatcgtgaccccatccatcgacggcagcatgatatcgatgatcagcaaatcccaatcacctgatttaaaacggttatatccttcgagtccgtcatggacgaactctgtttcaaatccttcttttgcaaaaaacatctctgtcatagtacatacgcttaaattatcttcaatcattaatattttcatcgtaaaagtgcctccgctagacaaacgttagattcattttacatagggcccagccatttctcaattccattctgaacatttaaaggtctggcaacagtttggtcataatttattcataagtagcggctaagatgaaatcaagcataaggcaaaagtcctgctgccgttagatttggcagcaataataaatgaaatagatacggaggaatcacgcgttatgaattttttcaaacgagccttttggagcatgaaagcgaaaaaaggaaaaacacttttacaattgtttgttttcacgatgatttgcgtgctcgtgctgacaggaattacgatccagtcggcagccgtgaaatcgagcgaactggcgagggaacagctcggaggcagcgtcacgctcaaagttgacagggaaaaaatgatgaaagaacagcaggactcaggagaccggaaaaggtttgaatcgacccccgtttctctcaaatcagccgagaaacttgcgagcctttaccatgtcaaaagctataacttcatctcctcaacatctgctttagcggacaacttcgatccgatcgaaagcggtgacgaggattcaacggactcaaacagcgatcagccggccggatcgggcggcaatgaacagggcggccggcaaatgatgcaggctgacgtatcaatcgaaggtgtgacaagcacagccctcgtcgacgaatttgccgacgggacgtccaagatcacggaaggccgtgctttaacaaaggatgatgtgaatgaaaaagtcgccgtgattgaagaaacgcttgccgaagaaaacgagctgaaggtcggcgatacgatcaaagtcaaagcgagcagcgatgaagatgcaacgatcaatttaaaaatcgtcggaatctataaaacgacttcatccggagacaatcaagcgcaaaacttcgcctttttaaacccttataacaaaatctatacaccatatacggcggcatcggccttaaaaggcgacgattatcaaaacgcgatagatgaagcggtctacaatatggacgacgcctccaacatcgacgctttcattgcggctgccaagaaaacaggcattgatttggatacattcacattggacgccaatgaccagttgtaccagcagatggtcggcccgattgaaaatgtcgcctccttctcgaaaaatgtcgtctatcttgtcacggtcgccggggcggtgattctcggactgatcgtcatgatgtcaatcagggagagaaaatacgaaatgggtgttctgatggcgatcggcgaaaaacgccggaaactcatcggacagtttttaaccgaaatcttaatgatcgcagtgcttgccatcgggatctcagcattaaccggcagcctgattgcaaagcaaatcgggaaccagctcttgagccagcaaatcgaacaaacgtcagctagccagtctgcaggcggaatgatgggcccaggcggcggaggcttcttcggacaaagtactgctcaagtctcagccattgatcagctcgacattcaagtatccttcgggaacttaatggcacttggcggaatcggccttttaattgcgatgttcgcgacactccttccgtccatatctgttttaaggctccatccgaaaacgattttaacaaaacaagaatagaaagaagtgaagattatgggcagtattttagaatttcagaatgtcggctattggtataaaaatcaggatcagcctctattcgaggatatcagcattcaattcagccaaggactcttatatacgattgtcgggacttccggttccggcaaaaccacctttttatcgttggcgggcggacttgacgcgccaaaagaggggaacatcctctacaaaggagaaaacatttcaaaaatcggactgaccagcttccgcaatcaatatgtatcgatcgtttttcagtcctataacctgctgccgtatatgacggctctccaaaatatcacgtcggccatggaaatcaccggatctcaggtcaaaaacaaggaacaatacgctttggagatgctcgaaaaggtcggcatcggcgaaaagcaggccagacagaaagtattgacattaagcggcggccagcagcagcgtgtctccatcatcagagcgttctgctgtgacacggattt

SEQ ID NO: 232 - protein, 479 aa, Bacillus licheniformis
MNFFKRAFWSMKAKKGKTLLQLFVFTMICVLVLTGITIQSAAVKSSELAREQLGGSVTLKVDREKMMKEQQDSGDRKRFESTPVSLKSAEKLASLYHVKSYNFISSTSALADNFDPIESGDEDSTDSNSDQPAGSGGNEQGGRQMMQADVSIEGVTSTALVDEFADGTSKITEGRALTKDDVNEKVAVIEETLAEENELKVGDTIKVKASSDEDATINLKIVGIYKTTSSGDNQAQNFAFLNPYNKIYTPYTAASALKGDDYQNAIDEAVYNMDDASNIDAFIAAAKKTGIDLDTFTLDANDQLYQQMVGPIENVASFSKNVVYLVTVAGAVILGLIVMMSIRERKYEMGVLMAIGEKRRKLIGQFLTEILMIAVLAIGISALTGSLIAKQIGNQLLSQQIEQTSASQSAGGMMGPGGGGFFGQSTAQVSAIDQLDIQVSFGNLMALGGIGLLIAMFATLLPSISVLRLHPKTILTKQE

SEQ ID NO: 233 - DNA, 1789 bp, Bacillus licheniformis
  CDS (501)..(1289)
tgatcttatttttggcaactgttgccgtcgcctacatttccgagcacctcgtccatacgtttgatacggtggccgaacaattcggctggtcggagcttttcatcggggtcatcattgtcgcgatcgtcggaaacgcggcagagcatgcttccgccgtcattatggcctataaggacaaaatggatgtcgcggttgaaattgcgatcggatcaacgcttcagatcgcgatgtttgtcgcccctgttcttgtcatcagctctttgttttttccaacgagcatgccgctcgtctttaccttgccggagctggtcgccatggcttccgccgtccttttgatgatcatcatttccaacgacggggacacgaactggtttgaaggcgcgacattgctggccgcttatatcatcatgggaatcggttttttccttctttaaaaaaatcgggataaacagagagcatccggaaaacaataaggaaaaagaaacagaaagagtgatagtatgaaaaagcttttgtgttttacgctgactgcgtttttatcctttagttttttcgctgtacaggaagctgacgcagccaagccgatcaagattccaagctctgtcacgaatatttccaaagagaacacataccctaacgcctctcaggatcagccgaggctgcagccgagcgaattagccgaagagctgctgaaaacaaccgatattgcgattgaaaatccgcatctgattaaaatgctgaatgagtcaagcatttccggcacaccgctggcaatcggctatcgggcgacgatttatttgggcagatgggcgctaggttacacctcgaatgaaaccgttgcgaactgggaataccgcaaaatcaacacaaaccgctttgacaaccggggcgggaaagcacctgcagaactcacgtattcccaggaacagacgagcaaaatcaaaggcggcttaacagcgaaagttccaaaggcggaagatgtcaaaaatatgatgatgctcaaagccatggaaaaaacaaagctgccgctcgcctttgaaacagtggtcggctccggtacaaaacgcgatcagatttataaagtgcagccgaaaaaactgggaaatttacacgcctatgcacctgccgtcaatgaaaaaggaaaagtcacctacggcgaagtgtacatcgtattaaaaggcaacaaaagaaagctagtcgtcaaaaatatcacctcgcaaggaatcggcgcttggattcctgtacaggatcacctgacattcggctttcagctcagccatcagccgaaataaaaaagcaagcctttgcggcttgcttttttcatactcttgctgttctggaagtaaaatcaacatcttgataatagctgtttttgacgagcacattcggtccgaggcaccggacgtgcgggcagtggcagttgagttctttggcaagctctgtttttctccacttcgcgtaggcgcttggcaggctgtctgtctgaatgttgccgagcggcggagtatctccgaaatcggtcacgatgatattgccgtcaaaaatattgacgttcaggcgcgatctgccgtcagggtcgtttctgacggtgacgtttttcgcttcgcgcagccgctgtaagagggcgtgatcttcaggatcagggctgcacgcgtaaaacggcagagtgccgaacagcatccacgtattttcgtcgcgaatgtcaagaaggcggtggatcgcttttctcatgtcttttaagcttaaagattcaagtgcgcttgcaaagtcgctcggatacatcggatgg

SEQ ID NO: 234 - protein, 263 aa, Bacillus licheniformis
MKKLLCFTLTAFLSFSFFAVQEADAAKPIKIPSSVTNISKENTYPNASQDQPRLQPSELAEELLKTTDIAIENPHLIKMLNESSISGTPLAIGYRATIYLGRWALGYTSNETVANWEYRKINTNRFDNRGGKAPAELTYSQEQTSKIKGGLTAKVPKAEDVKNMMMLKAMEKTKLPLAFETVVGSGTKRDQIYKVQPKKLGNLHAYAPAVNEKGKVTYGEVYIVLKGNKRKLVVKNITSQGIGAWIPVQDHLTFGFQLSHQPK

SEQ ID NO: 235 - DNA, 2866 bp, Bacillus licheniformis
  CDS (501)..(2366)
ttccgcgtccgtgcggatttattttcgatcatgatcagctatgccacactggtggccgggctcatctatctcgtggttttcatttatatttttccgctttacgttcatgttcagctgccgtttgtccgctatttttcacaggctgcgctgatcggtctcgttcgccctttgacgacggccggaatggctgctgctggttgcttggtcgtgtatgtgctgttgacggttccgggtctgatcccattttatggtgtcagtttgtttgctcttgtatcgatgtttatcgcacatcgctgttttttgcgtctggaaggctagctgaactgtgcaaaaatgagaaaatcgggcaaaaaaatatcaattggaaaggctgaaccgcttaagaccggacttgaacacatcttttcccttcggcaaaaaagtgcaattgaataaaaatggaagccgtaatagaatcccttttgagtaagcgtttacaaaaatggtgaagggagaagatgatgaaaaaaggaaagaaaaggtggaagaacctgttggccgcgtcatctcttttattaatcacgctagtgaccggcttctcggagcaagctgaggcagacgggcggacggctgcgcaggcaaggcaaatggaatcgcttaacagggggcttgtcgctgttaaaacggggaacggtgtctttgtcagctggcggcttctgggaaccgagccgtcttctgtttcatttaatgtgtatcgaaacggaaagaagctgaacggttctccgattacatcgagcacaaactatcaggatgcaggcggggatttgaacgccgtttaccaggtgcgcgccgttttgaacggcagggagcaggctccttctgaatccgtcggcgtattgaataaacaatataaatctgttccgctgcaaaaaccggccggaggaaaaacgcctgatggggtgtcatacacatacagcgccaatgatgcgagcgtaggcgaccttgatggagacggccaatatgaaatcattctcaagtgggatccttccaattcaaaggataattcacaggacggatacacgggagatgtgctgattgacgcatacaagcttgacggcaccatgatgtggagaatcaaccttggcaaaaatattcgcgccggcgcccattatacgcagtttctcgtctatgactttgacggcgatggaaaagcggaaatcgccatgaagacggcagacgggacgaaggacggcaaagggaaggtgatcggcaatgcaaacgccgattaccgcaatgcccaaggccgaattttgtcagggcctgagtatttgacggtttttaaaggcgatacaggcgctgagcttacaacggtcaactacgaacctgcccggggaaatgtagccgattggggagacagctacggcaacagggttgaccgctttctggccggtgtcgcataccttgacggggagcggccgagttttgtcatggcacgcggttattacacgagaacagtgctagtcgcttacaacttcagaggcggaaagctgaccaagctgtggacgttcgattcggatgctcccggaaatggcgcctatgccggtcaaggcaaccacagtttgagcgtcgccgacgttgacggagatggaaaggacgagatcatatacggagcgatggctgtcgatcatgacggaaaaggcctctactcaaccggctggggacatggggatgccatgcatacagggaacctggacccgtcaaggcctggactggaagtcttccaagtccatgaaaacagcaattctccttatggcttgtccttccgcgatgcgaaaacaggaaagatcatctggggagttcacgcaggtaaagatgtcggacgcggaatggccgctgatatcgatccgcgctacgaaggagcggaagtatgggcgaacggcagtctttatacggcaaaaggcgtaaaaatcggaaacacattgccttcatcaacgaacttcggcatctggtgggacggcgatctccaaagagagcttctggacagcaacagaattgataaatgggattatcaaaattcgcgaaccgtcaacttgctgacagcgtccggagcttcggcaaataacggaacaaaagcgacgccgtccctgcaggcggacattctcggagactggcgcgaagaagtggtctggcgagcggaggacagcagcgaactgcgcatctacacgacgacagacgtgacggagcaccgcatgtatacgctgatgcatgatgcagtctatcgcctcggtatcgcctggcagaatgtcggctacaaccagcctccgcacaccggcttttatttaggcgaaggcatgcagacaccggagaagccgaacatttatacacgctgatgataaaggggagctgcataatgaagcgatatgttcgctgcttatgggtcatccccctccttttctttttcatcatgggaatgggggacctgcgcagccgaaagccgctgccgcgcatcacagtcaggatctttttctgttcgattttggaaaaggtcccgctgagaaggattatgtgaaagtgaacgagtcctccgtgtatcaaaatggtgctggctacggattttctcaggcaggaagcgctgtgtgcaaaaagacgcaaaaaaaagaagcgctcaaaaaagactattgtatcgtgaaccggacggcttttctggcagatctctcccccggcaaataccgcgtgaccgtttttgcatcatccagcggtgaattgaagctttatgccgaaggagaaaaaatggggacgatcccggccggagcaaagggaagctcagccgaaaaagcgttcaccgtttcggtggaagacgggcgcctcgatctggagtgaaggggcc

SEQ ID NO: 236 - protein, 622 aa, Bacillus licheniformis
MKKGKKRWKNLLAASSLLLITLVTGFSEQAEADGRTAAQARQMESLNRGLVAVKTGNGVFVSWRLLGTEPSSVSFNVYRNGKKLNGSPITSSTNYQDAGGDLNAVYQVRAVLNGREQAPSESVGVLNKQYKSVPLQKPAGGKTPDGVSYTYSANDASVGDLDGDGQYEIILKWDPSNSKDNSQDGYTGDVLIDAYKLDGTMMWRINLGKNIRAGAHYTQFLVYDFDGDGKAEIAMKTADGTKDGKGKVIGNANADYRNAQGRILSGPEYLTVFKGDTGAELTTVNYEPARGNVADWGDSYGNRVDRFLAGVAYLDGERPSFVMARGYYTRTVLVAYNFRGGKLTKLWTFDSDAPGNGAYAGQGNHSLSVADVDGDGKDEIIYGAMAVDHDGKGLYSTGWGHGDAMHTGNLDPSRPGLEVFQVHENSNSPYGLSFRDAKTGKIIWGVHAGKDVGRGMAADIDPRYEGAEVWANGSLYTAKGVKIGNTLPSSTNFGIWWDGDLQRELLDSNRIDKWDYQNSRTVNLLTASGASANNGTKATPSLQADILGDWREEVVWRAEDSSELRIYTTTDVTEHRMYTLMHDAVYRLGIAWQNVGYNQPPHTGFYLGEGMQTPEKPNIYTR

SEQ ID NO: 237 - DNA, 2188 bp, Bacillus licheniformis
  CDS (501)..(1688)
gacgatttcctgaaaaaacgtaaacgccgggtagacgccgccaagcggaatgccttgatcaggaacgagccctttcaaaataaaatcgatcgctccgaactgaacgagaataaagccgtaaaaaaacatgacatggatgatgccgctttttttatctttaagcagtttcttttggccgaacacgttctcccatatcttttgaaggcgctccttcgtccgcttatcaaaatcctctttttgtccgagcctgatgtaactgattctcgttctgatcaaatagacgaacagataaacggcgtaaacggttacacctaaaaacgcaatgaaattcaacgacagcaagacattcatcagctgctccccctttcatttccccaaccttaaatccccttgaactacctttatcttaaataatgaatgagtgttcagtcaatatattttcataaatgcaggaaaatagggggacactattctttacacgaaaaaagggagtgtcttcattggtgccgcttatgattatggtatgttttctcatcctgcttcttgcgctcgatttccattttggccgcaaagcctttgagaagaaagcctacgagcccgttttttcagagaagaaaagcgatattgaactgattcataatggagaagacttgtgtgagcggctgctggatgacatccgccaggccgaatcgtcggtgcatgtcatgttttatattgtgaagaacgatgacatcagccttgaatttttgaaggtgctgaaggataaagcgaaatccggcgtatgcgtacgattgctgatcgaccggatcggcgcgatgaaggtgaagaaaaaaacgctctccggcctgaaacaaagcggtgtgcacgtttttttcgccaacaagccgggcttcccctatttcttttaccggctgaatgcgaggaatcatcgaaaaatcgccgtcatagacggaaagatcggctatgtgggcggatttaacatcgcgaaagaataccttggtaaaaaagcggaattcggaccgtggaaggattaccatttgcgaatgacgggagaaggcgttgccgacttgcagcacatttttatatcggacttcaaaagagaagcgccgcaggcaaagccggccaacagcgtatttccgccgctgcagcaaggagctgtcacccatacaacccatgcgacaaagggattttctctagaggaaaaatacatttcatttatcgaacaggcaaaagaaagaatcatgatttgcacgccgtactatattccgagcccggctttgcagcaggctgttctctcagccagggaaaggggcgtgatcgtgtcggttctcgtgccgatgaaacccgatcatccgcttgtcaaagaggccgcctacacgcactttccagcccttttaaaagcgggctgctatatttaccggtactacagaggcttttatcatgcaaaagcattaatcgtcgatgaccggcatgtgatgatcggaacatcgaattttgacaacaggagcctgtttctcaatgatgaagtgaatgtcgtcatccatgataaagactggacaaagcaattcttcgacgtcgtcaaggaaagcattgaacacgccgagcttctgacaaaggagcggtatgcgaagcggccggtgatgcagcggcccgtcgaatggctggcgaaatcgatttcattctttttataaaacgtacgtttatcctgcatgacatgcgggtaacatttcaccaaagtgatgattacatacggaggggatgtacgatgaaccaagcagagtcgattaaactccgcgcccaatcgatgacgttaaaaaacttgattgagctgtacaagctttgccgctcagccagacatcagctatatatatgctcaagaaaaacgatgtgcaaaatcaaagatttaattgagctggaaatgttcagaatggccaatcgcgaaaatgagtgcctgattgtcatcgaagggaaaatggcgcaggaattagtaaaaaaagcacaatcgattctttctgacgctcaagttcaataagggaaggcggaagttcttcctttgcgagacgcctcctcaccaaatcaagaaaaaatcccccgttcaatggacgggggattcgttttacattttttcaggcgctgatacgccgatcagcttgagggcattatttaatgtgatttgcgttgctttcat

SEQ ID NO: 238 - protein, 396 aa, Bacillus licheniformis
LVPLMIMVCFLILLLALDFHFGRKAFEKKAYEPVFSEKKSDIELIHNGEDLCERLLDDIRQAESSVHVMFYIVKNDDISLEFLKVLKDKAKSGVCVRLLIDRIGAMKVKKKTLSGLKQSGVHVFFANKPGFPYFFYRLNARNHRKIAVIDGKIGYVGGFNIAKEYLGKKAEFGPWKDYHLRMTGEGVADLQHIFISDFKREAPQAKPANSVFPPLQQGAVTHTTHATKGFSLEEKYISFIEQAKERIMICTPYYIPSPALQQAVLSARERGVIVSVLVPMKPDHPLVKEAAYTHFPALLKAGCYIYRYYRGFYHAKALIVDDRHVMIGTSNFDNRSLFLNDEVNVVIHDKDWTKQFFDVVKESIEHAELLTKERYAKRPVMQRPVEWLAKSISFFL

SEQ ID NO: 239 - DNA, 2785 bp, Bacillus licheniformis
  CDS (501)..(2285)
atgaactttcactgctgacggaaccttctctcaaagccgctttacaacactgtccggatattcgcctcacgtcttacgccggtctatgaaagagatgccgcttctattccttggcttaataagatgtgaaatggggtaggaagcggcggttgtttagtcaaatacttcatatttacagtttggaaaattctgattaatataaatttgtcataacaaatttatgcattcttcatcattggaaagtcttcttttacacttaaatgtatagacgtctatacgtgtttcaccctctgcacaaccagctttttcaaacgccaaagttttgatgaaatgatgttgtcaatctcacttatgtaagcgttttcccttgttgtcttcaatgtatctgctgctattagatgacaaggaaaaatataaaaccagcaaaaaaggcggtgaggaaaaagagagttctagtttcatagcttgccaaaaaattgcttgtaaaggagatgaaaatcgtgttgatcaacaaaagcaaaaagtttttcgttttttctttcatttttgttatgatgctgagcctctcatttgtgaatggggaagttgcaaaagccgattccggaaaaaactataaaatcatcggctactatccatcatggggtgcttatggaagggattttcaagtttgggatatggacgtttcgaaagtcagccacattaattatgcctttgctgatatttgctgggagggaaggcatggaaaccctgatccgacaggccccaatcctcaaacgtggtcatgccaggatgaaaacggagtgatcgacgcgccaaatggaacaatcgtgatgggcgatccctggattgacgcacaaaagtcaaatcccggggatgtctgggatgaaccgatccgcggcaactttaaacaattgttgaagctgaaaaagagccaccctcatttgaaaacgttcatatcggtcggggggtggacttggtctaaccgcttttcagatgtcgcggcagatcctgcggcaagggagaatttcgccgcttcggccgttgagtttttaaggaaatacgggtttgacggggtcgatcttgactgggaatatccggtcagcggaggattgccggggaacagcacacgtccggaagataaaagaaactacacgctgctcctgcaagaggtgcgcaaaaaacttgacgctgcagaagcaaaagacggcaaggaatacttgctgacgatcgcatccggcgcaagtcccgattatgtaagcaacactgagctcgataaaatcgctcaaaccgtggattggattaacattatgacctatgactttaatggcggatggcaaagcataagcgcccataatgcaccgctgttctatgatccaaaagcgaaagaagcaggcgttccaaacgctgagacctacaatattgaaaacactgtgaaacgctacaaggaagccggtgtcaagggtgacaaattagtgcttggaacaccgttctacggaaggggctggagcggttgtgaaccaggggggcacggagaatatcagaaatgcggaccggctaaagaagggacatgggaaaagggcgtattcgatttttcagatcttgaaaggaactatgtgaatcaaaacggctataaaaggtattggaacgatcaagcaaaagtgccgtttttgtataatgcggaaaatggcaatttcatcacttatgatgatgaacaatcattcggccacaaaacggattttattaaagcaaacggattaagcggagcaatgttctgggatttcagcggcgattccaatcggacgcttctcaataaattggcagccgatttagattttgcaccggacggaggcaatccggagccgccttcatcggcacctgtgaatgtgcgtgtaaccggaaaaactgctacaagtgtcagcctggcgtgggatgcgccgagcagcggagcaaacattgcggaatatgtcgtgtcatttgaaaaccggtcgatatctgtaaaagaaacatcagcggaaataggcggcttgaagccgggtacggcctactcatttactgtttcagcaaaggatgcggatggaaagctccatgccggaccaacggtagaggtcacgacgaattctgaccaagcctgttcatatgacgaatggaaagagacgagcgcatacacaggcggagagcgggttgcatttaacggaaaagtgtatgaagcgaaatggtggacgaaaggcgaccggcctgatcaatccggtgaatggggcgtatggcggctgatcggaggctgcgaataagagaaagtcaaatggatagaaaacgataaagagagatttggggaacagcttctcacgtctctctttatggacaaaggagtctgagtaaacatgaagaaagccgcttcatcttttttatcttgtatgctgctcctcgcgctttttatcccgaaccggcagatttccgcagagacttcaagcgaaagaccggactgccgtccggaagggctatgggactcgggcgttgaacatgtgccgtattgcgatgtatacgacaaggacggccgtgaaaagctggccaatcagttagaccggagaatcatcggttactttacgagctggcgtacgggaaaaggaaatcaagatcgttatttagtaagcgatatcccctggaagtacttgagccacattaattatgcgtttgcccacatcggggaagatcatcggatttcagtcggagaagaggcagatgagaacaacccgtccatcgggatgacttggccggagcatcccgatgt

SEQ ID NO: 240 - protein, 595 aa, Bacillus licheniformis
VLINKSKKFFVFSFIFVMMLSLSFVNGEVAKADSGKNYKIIGYYPSWGAYGRDFQVWDMDVSKVSHINYAFADICWEGRHGNPDPTGPNPQTWSCQDENGVIDAPNGTIVMGDPWIDAQKSNPGDVWDEPIRGNFKQLLKLKKSHPHLKTFISVGGWTWSNRFSDVAADPAARENFAASAVEFLRKYGFDGVDLDWEYPVSGGLPGNSTRPEDKRNYTLLLQEVRKKLDAAEAKDGKEYLLTIASGASPDYVSNTELDKIAQTVDWINIMTYDFNGGWQSISAHNAPLFYDPKAKEAGVPNAETYNIENTVKRYKEAGVKGDKLVLGTPFYGRGWSGCEPGGHGEYQKCGPAKEGTWEKGVFDFSDLERNYVNQNGYKRYWNDQAKVPFLYNAENGNFITYDDEQSFGHKTDFIKANGLSGAMFWDFSGDSNRTLLNKLAADLDFAPDGGNPEPPSSAPVNVRVTGKTATSVSLAWDAPSSGANIAEYVVSFENRSISVKETSAEIGGLKPGTAYSFTVSAKDADGKLHAGPTVEVTTNSDQACSYDEWKETSAYTGGERVAFNGKVYEAKWWTKGDRPDQSGEWGVWRLIGGCE

SEQ ID NO: 241 - DNA, 1741 bp, Bacillus licheniformis
  CDS (501)..(1241)
gacttaacatgcaacatcaaaactgttaaaatgacttgaaatgaccagcaacattcctttatcctacggcagaagagacgaggctggccggaagcaccaaaccggctgaacgtaaggaggcgtcatcaataatggaagagatcggacaacaggctgctgtcagtatcatcgttcatcttttttttattgcattgacttggtgggctcttctggcggtcaatattgatccgcttatcaggaaaggaaaagtcattcaggcgagggtgttaatgatcatcattacaatcgccgtcggctccaccgtcagcaattttttcttggactatctttattattccagacagcttcaaaatttattttcatgattgagtaaaagaatttatgggaatggacgaatatgggtaacaccgcgttctgcaaaatcaccggagaccttgtttttccacgtatgcttttcctgcgatccgtcaacaatggagagtaggagaggatgatgcagaatgaagacaaaacaaacggttaatgcccttatttttattgtggttttatttttaattgttcatgtctttcaatcgcttgaagcagcgggcaatacgccgcttgaacagctggcggaaggtttgagccgccatgatgtcgagcttgaagagtggaccatgcatacaaaaaaacagcttaccctaagtgaaaaagatttttttgcaaaactgaaacatttcaagaaacagcatcgacaatatgaatggactttaacgcgggaagacgacgatacagttaaagcgacaggtgtttttcaggacaaaaaaaatcatatcaattccaaaatacatttggtatccacccacaaaaaccagagacttgtttcgtatttattgtatgagcaaaaaggcgcgggaccacgggaaaactggaatgctacatataagcagtttgaacgggatgcattcgacataatgcgagaaaagaccgcaatttttacttgtctaaagggccatttaaatggtatgatgaatgttgttttgcaaaaaaaagcaaatgagctagtacatgaatttgatgcaaagtcagttgaagatttaattgaaccaaatttcgtttctatttctgcttacactaacgagtggaaagaatccatcaagacagaaaaacaccgtatgaatttgcaagtctcgcttagaaatgcgggaatgggcgaaaaacttaccgtcacggttggcacaccaatcgtcacgactgaatattaatatagagaaattgggacgcggaggggaataccttggaaaaaatcatcgtccgcggcggtcgaaagttaaacggcacagtcaaagttgaaggagcaaaaaatgccgttttaccagttatcgctgcatctttattagccagtgaagaaaaaagcgtaatatgtgatgtgcctacgctctccgatgtatatacgattaacgaagtgttacgtcatttaggcgcaagtgtacattttgaaaataatacagtaacggttgatgcatctcgcactttgtctacggaagctccgttcgaatatgttcgtaaaatgcgcgcatccgtattggtgatgggtccgcttcttgctcgcacaggccattcgagagtggctttgcctggaggatgtgcaatcggttcaagaccgatcgatcagcatctgaaaggctttgaagcaatgggggcaaaaattaaggtcggaaacggctttattgaagcgactgtagaaggccgccttcaagga

SEQ ID NO: 242 - protein, 247 aa, Bacillus licheniformis
MKTKQTVNALIFIVVLFLIVHVFQSLEAAGNTPLEQLAEGLSRHDVELEEWTMHTKKQLTLSEKDFFAKLKHFKKQHRQYEWTLTREDDDTVKATGVFQDKKNHINSKIHLVSTHKNQRLVSYLLYEQKGAGPRENWNATYKQFERDAFDIMREKTAIFTCLKGHLNGMMNVVLQKKANELVHEFDAKSVEDLIEPNFVSISAYTNEWKESIKTEKHRMNLQVSLRNAGMGEKLTVTVGTPIVTTEY

SEQ ID NO: 243 - DNA, 1948 bp, Bacillus licheniformis
  CDS (501)..(1448)
ctcatcaagctcaagttcgtgcggaaaggcgcccgcgccgttaaatcctgaattattgaccataacatcaagtgaaccaaagtgttcaactgctgaattaatcagctttttcacgtcctcttcggaagacacgtcagcttctatcgcaagggcgtttccgcccgctgcttgaatattgtcgacggcttcccgtgcgcctccgggatcgctgtgataattgacaaccacattcatcttttcttttccaaaccgttctgcaaccgccttgcctataccttttgaagagccggtcacaattgctgtttttccttttaaatcactatacaacctaaacacccctcaatttcttttctccatgtacattacccggtatcaatatatgatcaaacaaaatgttaatacacacctttagtatgatcttttttaaacatatggaaaattcagaattattttgttaatatctaacttgtacttacaacaaaataaggaagtgatatgatttggttagtaaaaagagtgttaaacgaggtttgatcacaggtctcattggtatttctatttattctttaggtatgcacccggcccaagccgcgccatcgcctcatactcctgtttcaagcgatccttcatacaaagcggaaacatcggttacttatgacccaaacattaagagcgatcaatacggcttgtattcaaaagcgtttacaggcaccggcaaagtgaatgaaacaaaggaaaaagcggaaaaaaagtcacccgccaaagctccttacagcattaaatcggtgattggttctgatgatcggacaagggtcaccaacacaaccgcatatccgtacagagcgatcgttcatatttcaagcagcatcggttcatgcaccggatggatgatcggtccgaaaaccgtcgcaacagccggacactgcatctatgacacatcaagcggttcatttgccggtacagccactgtttcgccgggacggaacgggacaagctatccttacggctcagttaaatcgacgcgctactttattccgtcaggatggagaagcggaaacaccaattacgattacggcgcaatcgaactaagcgaaccgatcggcaatactgtcggatacttcggatactcgtacactacttcatcacttgttgggacaactgttaccatcagcggctacccaggcgataaaacagcaggcacacaatggcagcattcaggaccgattgccatctccgaaacgtataaattgcagtacgcaatggacacgtacggaggacaaagcggttcaccggtattcgaacaaagcagctccagaacgaactgcagcggtccgtgctcgcttgccgtacacacaaatggagtatacggcggctcctcgtacaacagaggcacccggattacaaaagaggtgttcgacaatttgaccaactggaaaaacagcgcacaataatacacgaagacagcccgcttccttttggaacgggctgtcacatctaacggccgtatacttaatttcctttaagcctgtactttttgccatctattgatatcgtgaaatttgaaggaccgctgatcggcaaataatagacaagctgaaactccgcttcctcaccaggtttaatggttttccagattgatagagtcactctgatgcggtggaaatctactgtcagtccgccaatgttcggtcccgtatgccctttagaaatcacttcaacatgatcgccgctccagcttctaaaccgaggggaagtggatgtcggcgcatcaaattcgataaaagaacctcccgtaatcgtgacatcgctgttgttgatcagcttcatcaccgggtggatcgggtaattttgatctcctaacggaaagttcgtcaactctacttctgcatctagtgattcatcaggcaaaggtgatgtgctgagtcgattatcgtatggtgttgtatcc

SEQ ID NO: 244 - protein, 316 aa, Bacillus licheniformis
LVSKKSVKRGLITGLIGISIYSLGMHPAQAAPSPHTPVSSDPSYKAETSVTYDPNIKSDQYGLYSKAFTGTGKVNETKEKAEKKSPAKAPYSIKSVIGSDDRTRVTNTTAYPYRAIVHISSSIGSCTGWMIGPKTVATAGHCIYDTSSGSFAGTATVSPGRNGTSYPYGSVKSTRYFIPSGWRSGNTNYDYGAIELSEPIGNTVGYFGYSYTTSSLVGTTVTISGYPGDKTAGTQWQHSGPIAISETYKLQYAMDTYGGQSGSPVFEQSSSRTNCSGPCSLAVHTNGVYGGSSYNRGTRITKEVFDNLTNWKNSAQ

SEQ ID NO: 245 - DNA, 1231 bp, Bacillus licheniformis
  CDS (501)..(731)
attggccgggaaatttcccggacctgtggaggaaacctccattattgaaagccggccgggaatgggcgtccaccttgaaatcacccgcgcgtccggaggaaggagtttttggaggccttttctatataaggggagggaggagccaaaacggggacctttccgaaattatgtcaagccggtccccaaggtgctccaggccagatcctgaaaatggaacctcaggttattcggggtaggacctgctaaaccatgagggaggaataaaggaatggaccggaaagcccgcttcgtccaggaatttatgtcccaccgccttgtgccggaggacctcattcaaaaaattgatgaaaaccttttcgattccaacccgcctgaaccgtcgatgccaccaaaggaccttgtccacgcatatgctgcaatctttctatacctttgcttcggcggcaaaggaagggaccggagacccttttaaaaagaagcccgaagaaccagggacaagcttgagcgagcttgccaaaacgtatccagaaaaaacaaaaacgctgcttgaatcctttacggatgaagaattggatcgtgaagtcgatttgaccggcgtcttcggacgaaaagtagccggcgaacagctactgcagctcgcgatcggacacgaaattcaccacaaaggcaatctgtttgtttatgtccgtgaaatgggacacacggatctgcctttgtatgtaaagattcattgatcctgagagccctccttgaaagaaaaccggttaaaaaggaatacgaaagcacccgggagtacacattatgagtaaaagctaaaggagggtgtcaggtgaatacgcagcgtgcccaggaaatcgtcgaatcacccgatatggttgatgttacttataacggcaggccgatttatattcagcgtgtcgacgaacaaaatgaaaccgcaagaatctttccgctcggccagccggagaacgagcaggaagtgccgctcgcaaatttgaaagaacattaaaaagaaaccccttctgaggaaggggttttgttttggatttgcctgccacacagccatcaaaaaaacacccgaaagaccgagtgtttaatttataattttcgcaagtcctcttactgccagcctcagcacataaaacaatggctcaagcaaatcgacgagataaagataatcccatttgtcatcattacgtttattttttttcttcaacgaatgtttctcctt

SEQ ID NO: 246 - protein, 77 aa, Bacillus licheniformis
LSELAKTYPEKTKTLLESFTDEELDREVDLTGVFGRKVAGEQLLQLAIGHEIHHKGNLFVYVREMGHTDLPLYVKIH

SEQ ID NO: 247 - DNA, 1597 bp, Bacillus licheniformis
  CDS (501)..(1097)
ggccattcttttccctccaatctttgtgaattttttgtaaattgaagttctattaatcatagcataaactgccgccgtctgtgaataacacggaaatgcatgtttgttggcgaaaaaattcattcccgaaattaaatcgtcattttccaaaaaaagtgcgcgaaaaaagcgaaaaccgcgccaagcggaatacaggagatcattgcggttccgttgaccagcccgtcagccccgcttattttcagggcttcccggtagcctattaaaaagtggatgatcgataggacataacataagagcatcatatagtaaggattcatttgtataccctcctctattcgctttactatattacattcaatagagggaaagattatgcctgtttaagtaggaaaaagaacaaaatattatagacgaaaagattttcaattacaatacatgtttttaaaaatatttccactataatcaaaatgaaagataaatttagggggtcatacaaaatgaaaaaaaggctgatgtcactattggtctgcatcctggttttagtgccggcagcaggagcttttgccgcgccgaaacaggccgagcttaaagattatcttgaagaaataggaatgacagaaaaagaattggaagcctatttgcaggatacatatgatgagagtttaaaaggttttgactcggtggaagagttgaaagactttttagggcaaagactgactaaaaagcttttggcatcctatttgaaagaatacggattgagcgaaaaagaagcggctgacctatttgttgaaaatggctatatggaaagcggccaaaacattctcgacgtgtttatgtttgaatacgaattggacgatgcgctctacaccgtgacatatgaagaagacgattttcagatcggaaacatgtttcaagaattgggtgtggatgatcaggagtgggaaagactcgtgaatcacctccgaaaagtgcgcgataacaatccgaaccttgaaaatgacttgatggctcttggagaacgtcttgaagcggtagccgatttcgagtctgtatcagagctgtcagctcaggatatcgctgaatgctgtccattttaacgatcttcagaagacgctcgaagtgaaaacgaatattatcttgttaagacggaaagaaaaaagaagtgtctttgacgacgcttgtcagtgctgaagatctgaagggagcaagcctcctagtggaagtatacgatctgcagggcaatttcattttggatgtattgctgacgcctgaaatgatcggatctgatttaattcatgacacagggtcgaaagtgaagcaaacccaaacggctgttaaacacgacgcaaagaaatctcatgtgaaaaagacggttaaaggtgcaaagcttccgaaaacggccgggcattacgcagaatggtcgatctttggcgccgttctgatgtttggcggattgtttatggtcagaaggcttcgaaaagcggcttaacattttacttcccattctaagtctgtatagaatgggaagtttttataaggagtgaaaggaaattaaggcacatcgaaaaaagatcatctggcttgcagccattgc

SEQ ID NO: 248 - protein, 199 aa, Bacillus licheniformis
MKKRLMSLLVCILVLVPAAGAFAAPKQAELKDYLEEIGMTEKELEAYLQDTYDESLKGFDSVEELKDFLGQRLTKKLLASYLKEYGLSEKEAADLFVENGYMESGQNILDVFMFEYELDDALYTVTYEEDDFQIGNMFQELGVDDQEWERLVNHLRKVRDNNPNLENDLMALGERLEAVADFESVSELSAQDIAECCPF

The invention claimed is:

1. An isolated mutant host cell of a parent *Bacillus licheniformis* host cell, which mutant host cell comprises a mutation in a gene encoding a secreted polypeptide which has an amino acid sequence which is at least 95% identical to SEQ ID NO: 134, wherein the mutant host cell secretes at least 5% less of the secreted polypeptide than the parent host cell when they are cultivated under comparable conditions.

2. The host cell of claim 1 which is mutated by a partial or complete deletion of the gene.

3. The host cell of claim 1, wherein the polypeptide has an amino acid sequence which is at least 96% identical to SEQ ID NO: 134.

4. The host cell of claim 1, wherein the polypeptide has an amino acid sequence which is at least 97% identical to SEQ ID NO: 134.

5. The host cell of claim 1, which further comprises a mutation in a second gene encoding a second secreted polypeptide.

6. The host cell of claim 1, which comprises one or more heterologous gene(s) encoding one or more heterologous polypeptide(s).

7. The host cell of claim 6, wherein the heterologous gene(s) are present in at least two copies.

8. The host cell of claim 6, wherein the heterologous gene(s) are stably integrated into the genome of the cell.

9. The host cell of claim 6, wherein the heterologous gene(s) are integrated into the genome of the cell without leaving any antibiotic resistance marker genes at the site of integration.

10. The host cell of claim 6, wherein the heterologous gene(s) are transcribed from a heterologous promoter or from an artificial promoter.

11. The host cell of claim 6, wherein the heterologous gene(s) are comprised in an operon.

12. The host cell of claim 6, wherein the heterologous polypeptide(s) are antimicrobial peptides and/or fusion peptides comprising a peptide which in its native form has antimicrobial activity.

13. The host cell of claim 6, wherein the heterologous polypeptide(s) have biosynthetic activity and produce a compound or an intermediate of interest.

14. The host cell of claim 13, wherein the compound or intermediate of interest comprises vitamins, amino acids, antibiotics, carbohydrates, or surfactants.

15. The host cell of claim 14, wherein the carbohydrates comprise hyaluronic acid.

16. The host cell of claim 6, wherein the heterologous polypeptide(s) are enzymes.

17. The host cell of claim 16, wherein the enzyme is an enzyme of a class selected from the group of enzyme classes consisting of oxidoreductases (EC 1), transferases (EC 2), hydrolases (EC 3), lyases (EC 4), isomerases (EC 5), and ligases (EC 6).

18. The host cell of claim 17, wherein the enzyme is an amylase or a mannanase.

19. A process for producing at least one product of interest comprising cultivating the *B. licheniformis* mutant host cell of claim 1 in a suitable medium for production of the at least one product.

20. The process of claim 19, further comprising isolating or purifying the at least one product of interest.

21. The host cell of claim 1 which is mutated by a complete deletion of the gene.

* * * * *